United States Patent
Lessard et al.

(10) Patent No.: US 9,598,700 B2
(45) Date of Patent: Mar. 21, 2017

(54) METHODS AND COMPOSITIONS FOR PROCESSING BIOMASS WITH ELEVATED LEVELS OF STARCH

(71) Applicant: Agrivida, Inc., Medford, MA (US)

(72) Inventors: Philip A. Lessard, Framingham, MA (US); Michael Lanahan, Cary, NC (US); Vladimir Samoylov, Sudbury, MA (US); Oleg Bougri, Boise, ID (US); Jonas Emery, Eugene, OR (US); R. Michael Raab, Arlington, MA (US); Dongcheng Zhang, Newton, MA (US)

(73) Assignee: Agrivida, Inc., Medford, MA (US)

( * ) Notice: Subject to any disclaimer, the term of this patent is extended or adjusted under 35 U.S.C. 154(b) by 266 days.

(21) Appl. No.: 13/793,078

(22) Filed: Mar. 11, 2013

(65) Prior Publication Data

US 2013/0269061 A1 Oct. 10, 2013

Related U.S. Application Data

(63) Continuation-in-part of application No. 13/806,654, filed as application No. PCT/US2011/041991 on Jun. 27, 2011.

(60) Provisional application No. 61/358,720, filed on Jun. 25, 2010, provisional application No. 61/726,301, filed on Nov. 14, 2012.

(51) Int. Cl.
*C12N 15/82* (2006.01)
*C12P 19/14* (2006.01)
*C12N 9/12* (2006.01)

(52) U.S. Cl.
CPC .......... *C12N 15/8245* (2013.01); *A23K 10/12* (2016.05); *A23K 10/30* (2016.05); *A23K 10/38* (2016.05); *A23K 40/10* (2016.05); *A23K 50/10* (2016.05); *A23K 50/30* (2016.05); *A23K 50/75* (2016.05); *C12N 9/1294* (2013.01); *C12N 15/8218* (2013.01); *C12N 15/8246* (2013.01); *C12P 19/14* (2013.01); *C12Y 207/09004* (2013.01); *Y02P 20/52* (2015.11); *Y02P 60/873* (2015.11)

(58) Field of Classification Search
None
See application file for complete search history.

(56) References Cited

U.S. PATENT DOCUMENTS

| | | |
|---|---|---|
| 5,432,074 A | 7/1995 | Evans et al. |
| 5,496,714 A | 3/1996 | Comb et al. |
| 5,654,184 A | 8/1997 | Curtiss et al. |
| 5,780,708 A | 7/1998 | Lundquist et al. |
| 5,834,247 A | 11/1998 | Comb et al. |
| 5,912,415 A | 6/1999 | Olszewski et al. |
| 5,981,835 A | 11/1999 | Austin-Phillips et al. |
| 6,013,863 A | 1/2000 | Lundquist et al. |
| 6,022,846 A | 2/2000 | Van Ooijen et al. |
| 6,160,208 A | 12/2000 | Lundquist et al. |
| 6,395,966 B1 | 5/2002 | Mumm et al. |
| 6,521,816 B1 | 2/2003 | Frohberg |
| 6,531,316 B1 | 3/2003 | Patten et al. |
| 6,800,792 B1 | 10/2004 | Howard et al. |
| 6,858,775 B1 | 2/2005 | Xu et al. |
| 7,049,485 B2 | 5/2006 | Sticklen et al. |
| 7,102,057 B2 | 9/2006 | Lanahan et al. |
| 7,186,898 B1 * | 3/2007 | Kossmann et al. ........ 800/320.1 |
| 7,361,806 B2 | 4/2008 | Lebel et al. |
| 7,557,262 B2 | 7/2009 | Lanahan et al. |
| 7,838,732 B2 | 11/2010 | Lebel et al. |
| 7,855,322 B2 | 12/2010 | Lanahan et al. |
| 7,906,704 B2 | 3/2011 | Raab et al. |
| 7,919,681 B2 | 4/2011 | Lanahan et al. |
| 7,919,682 B2 | 4/2011 | Frohberg et al. |
| 8,101,393 B2 | 1/2012 | Gray et al. |
| 8,257,502 B2 | 9/2012 | Frohberg et al. |
| 8,343,747 B2 * | 1/2013 | Burke et al. ................. 435/205 |
| 8,420,387 B2 | 4/2013 | Shen et al. |
| 8,455,715 B2 | 6/2013 | Paul et al. |
| 8,481,810 B2 | 7/2013 | Lebel et al. |
| 2003/0159182 A1 | 8/2003 | Tackaberry et al. |
| 2003/0167533 A1 | 9/2003 | Yadav et al. |
| 2003/0233675 A1 | 12/2003 | Cao et al. |
| 2004/0034888 A1 | 2/2004 | Liu et al. |
| 2004/0096938 A1 | 5/2004 | Xu et al. |
| 2004/0123343 A1 | 6/2004 | La Rosa et al. |
| 2005/0125860 A1 | 6/2005 | Raab et al. |
| 2005/0239728 A1 | 10/2005 | Pachuk et al. |

(Continued)

FOREIGN PATENT DOCUMENTS

| | | |
|---|---|---|
| CN | 1564866 A | 1/2005 |
| CN | 1726282 A | 1/2006 |

(Continued)

OTHER PUBLICATIONS

Ritte et al, 2002, PNAS, 99:7166-7171.*
McMillan, 1994, Enzymatic Conversion of Biomass for Fuels Production, ACS Symposium Series, ISBN13: 9780841229563, p. 292-324.*
Altintas, M. M., "Improvement of Ethanol Production from Starch by Recombinant Yeast Through Manipulation of Environmental Factors,"Enzyme and Microbial Technology, vol. 31, No. 5, 640-647, 2002.
Aspegren, K., et al., Secretion of Heat-Stable Fungal β-Glucanase from Transgenic, Suspension-Cultured Barley Cells, Molecular Breeding, 1995, pp. 91-99.
Birch, R.G., Plant Transformation: Problems and Strategies for (Continued)

*Primary Examiner* — Jason Deveau Rosen
(74) *Attorney, Agent, or Firm* — Volpe and Koenig, P.C.

(57) ABSTRACT

Genetically engineered plants having altered levels of one or more starch regulation enzymes and a polysaccharide degrading enzyme are provided. Methods of genetically engineering plants to express products altering expression of one or more starch regulation enzymes and polysaccharide degrading enzymes, and genetic constructs are provided. Methods of agricultural processing and animal feed using the genetically engineered plants are described.

29 Claims, 32 Drawing Sheets

(56) References Cited

U.S. PATENT DOCUMENTS

| | | |
|---|---|---|
| 2005/0283850 A1 | 12/2005 | Snell et al. |
| 2006/0150278 A1 | 7/2006 | Frohberg |
| 2006/0236419 A1 | 10/2006 | La Rosa et al. |
| 2006/0272049 A1 | 11/2006 | Waterhouse et al. |
| 2007/0192900 A1 | 8/2007 | Sticklen et al. |
| 2007/0218530 A1 | 9/2007 | Duck et al. |
| 2007/0250961 A1 | 10/2007 | Blaylock et al. |
| 2008/0115243 A1 | 5/2008 | Raab et al. |
| 2008/0220125 A1 | 9/2008 | Abbas et al. |
| 2009/0119800 A1* | 5/2009 | Lanahan et al. ............ 800/284 |
| 2009/0155238 A1 | 6/2009 | Weiner et al. |
| 2009/0193541 A1 | 7/2009 | Miles |
| 2009/0258930 A1 | 10/2009 | Pachuk et al. |
| 2009/0298149 A1 | 12/2009 | Wang et al. |
| 2009/0320831 A1 | 12/2009 | Lanahan et al. |
| 2010/0124771 A1 | 5/2010 | Sabesan et al. |
| 2010/0143967 A1 | 6/2010 | McFarland |
| 2010/0159494 A1 | 6/2010 | Sweeney |
| 2010/0159510 A1 | 6/2010 | Raab et al. |
| 2011/0045127 A1 | 2/2011 | Ral et al. |
| 2011/0053195 A1 | 3/2011 | Bauer et al. |
| 2011/0111442 A1 | 5/2011 | Shen et al. |
| 2012/0040409 A1 | 2/2012 | Hau et al. |
| 2012/0054915 A1 | 3/2012 | Steffens |
| 2012/0258503 A1 | 10/2012 | Raab et al. |
| 2013/0269061 A1 | 10/2013 | Lessard et al. |

FOREIGN PATENT DOCUMENTS

| | | |
|---|---|---|
| CN | 1777677 A | 5/2006 |
| CN | 101910404 A | 12/2010 |
| CN | 101979548 A | 2/2011 |
| EP | 0602899 A2 | 6/1994 |
| WO | 9701642 A1 | 1/1997 |
| WO | 9821348 A1 | 5/1998 |
| WO | 0011144 | 3/2000 |
| WO | 0036093 A2 | 6/2000 |
| WO | 0052155 A2 | 9/2000 |
| WO | 0071701 A1 | 11/2000 |
| WO | 0159091 A2 | 8/2001 |
| WO | 02086112 | 10/2002 |
| WO | 03050265 A2 | 6/2003 |
| WO | 03/071860 A2 | 9/2003 |
| WO | 2005030942 | 4/2005 |
| WO | 2005095618 A2 | 10/2005 |
| WO | 2005095619 A1 | 10/2005 |
| WO | 2005097999 | 10/2005 |
| WO | 2007146944 A2 | 12/2007 |
| WO | 2008064314 A2 | 5/2008 |
| WO | 2009067751 A1 | 6/2009 |
| WO | 2010060056 A2 | 5/2010 |
| WO | 2010/099134 A1 | 9/2010 |
| WO | 2011057159 A1 | 5/2011 |
| WO | 2011163659 A2 | 12/2011 |

OTHER PUBLICATIONS

Practical Application, Annual Review of Plant Physiology and Plant Molecular Biology, vol. 48, Jun. 1997, pp. 297-326.

Bird, C.R., et al., The Tomato Polygalacturonase Gene and Ripening-Specific Expressions in Transgenic Plants, Plant Molecular Biology, 1988, pp. 651-662.

Brederode, F.T., et al., Complete Nucleotide Sequence of Alfalfa Mosaic Virus RNA 4, Nucleic Acids Research, vol. 8, No. 10, 1980, pp. 2213-2223.

Broothaerts, W., et al., Gene Transfer to Plants by Diverse Species of Bacteria, Nature, vol. 433, Feb. 2005, pp. 629-633.

Cameron, D.C., et al., Metabolic Engineering of Propanediol Pathways, Biotechnology Progress, 1998, pp. 116-125.

Cheon, B.Y., et al., Ovexpression of Human Erythropoietin (EPO) Affects Plant Morphologies: Retarded Vegetative Growth in Tobacco and Male Sterility in Tobacco and *Arabidopsis*, Transgenic Research, 2004, pp. 541-549.

Chih-Ching, C., et al., Establishment of an Efficient Medium for Anther Culture of Rice Through Comparative Experiments on the Nitrogen Sources, Scientia Sinica, vol. 18, No. 3, 1975, pp. 659-668.

Chin, Hang Gyeong, et al., Protein trans-splicing in transgenic plant chloroplast: Reconstruction of herbicide resistance from split genes, PNAS, vol. 100, No. 8, pp. 4510-4515 (2003).

Chong, et al., "Modulation of Protein Splicing of the Saccharomyces Cerevisiae Vacuolar Membrane ATPase Intein", Apr. 24, 1998, Journal of Biological Chemistry, vol. 273, No. 17, pp. 10567-10577.

Chong Shaorong, et al. ., "Single-column purification of free recombinant proteins using a self-cleavable affinity tag derived from a protein splicing element", Gene: An International Journal of Genes and Genomes, vol. 192, pp. 271-281 (1997).

Clarke, Neil D., "A Proposed Mechanism for the Self-Splicing of Proteins," Proceedings of the National Academy of Science, USA, vol. 91, pp. 11084-11088, Nov. 1994.

Coruzzi, G., et al., Tissue-Specific and Light-Regulated Expression of Pea Nuclear Gene Coding the Small Subunit of Ribulose-1, 5-Bisphosphate Carboxylase, The EMBO Journal, 1984, 1671-1679.

Dai, Z., et al., Expression of Acidothermus Cellulolyticus Endoglucanase E1 in Transgenic Tobacco: Biochemical Characteristics and Physiological Effects, Transgenic Research, 2000, pp. 43-54.

Dai, Z., et al., Improved Plant-Based Production of E1 Endoglucanase Using Potato: Expression Optimization and Tissue Targeting, Molecular Breeding, 2000, pp. 277-285.

Dale, Bruce E., Biobased Industrial Products: Bioprocess Engineering When Costs Really Count, Biotechnology Progress, 1999, pp. 775-776.

Davis et al., "Protein Splicing: The Lengths Some Proteins Will Go to", 1995, Antonie van Leeuwenhoek, vol. 67, pp. 131-137.

Davis, E., et al., "Novel Structure of the recA Locus of *Mycobacterium tuberculosis* Implies Processing of the Gene Product," Journal of Bacteriology, vol. 173, No. 18, 5653-5662 Sep. 1991.

Davis, E., et al., "Protein Splicing in the Maturation of *M. tuberculosis* RecA Protein: A Mechanism for Tolerating a Novel Class of Intervening Sequence,"Cell Press, vol. 71, 201-210, Oct. 16, 1992.

Derbyshire, et al., "Lightning Strikes Twice: Intron-Intein Coincidence," Proceedings of the National Academy of Science, USA, vol. 95, pp. 1356-1357, Feb. 17, 1998.

Evans, et al., "Semisynthesis of Cytotoxic Proteins Using a Modified Protein Splicing Element," Protein Science, vol. 7: pp. 2256-2264 (1998).

Gangopadhyay, J.P., et. al., "In Vitro Splicing of Erythropoietin by the *Mycobacterium tuberculosis* RecA Intein Without Substituting Amino Acids at the Splice Junctions," Biochimica et Biophysica Acta, vol. 1619, (2003), pp. 193-200.

Gimble, Frederick S., "Invasion of a Multitude of Genetic Niches by Mobile Endonuclease Genes", Feb. 8, 2000, FEMS Microbiology Letters, vol. 185, pp. 99-107.

Gordon-Kamm, et al., "Transformation of Maize Cells and Regeneration of Fertile Transgenic Plants," The Plant Cell, vol. 2, pp. 603-618, Jul. 1990.

Guilley, H., et al., "Transcription of Cauliflower Mosaic Virus DNA: Detection of Promoter Sequences, and Characterization of Transcripts," Cell, vol. 30, Oct. 1982, pp. 763-773.

Gupta, P.K., et al., "Shoot Multiplication from Mature Trees of Douglas Fir and Sugar Pine," Plant Cell Reports, vol. 4, 1985, pp. 177-179.

Higgins, T.J.V., "Synthesis and Regulation of Major Proteins in Seeds," Annual Review of Plant Physiology, 1984, pp. 191-221.

Hirata, R., et al., "Molecular Structure of a Gene, VMA1, Encoding the Catalytic Subunit of H+-Translocating Adenosine Triphosphatase fro Vacuolar Membranes of *Saccharomyces cerevisiae*," The Journal of Biological Chemistry, vol. 265, No. 12, Apr. 25, 1990, pp. 6726-6733.

(56) References Cited

OTHER PUBLICATIONS

Hood, E.E., et al., "Commercial Production of Avidin from Transgenic Maize: Characterization of Transformant, Production, Processing, Extraction and Purification," Molecular Breeding, 1997, pp. 291-306.
Horsch, R.B., et al, "A Simple and General Method for Transferring Genes into Plants," Science, Mar. 1985, pp. 1229-1231.
Ingram, L.O., et al., "Enteric Bacterial Catalysts for Fuel Ethanol Production," Biotechnology Progress, 1999, pp. 856-866.
Kane, P.M., et. al., "Protein Splicing Converts the Yeast TFP1 Gene Product to the 69-kD Subunit of the Vacuolar H+-Adenosine Triphosphatase," Science, New Series, vol. 250, No, 4981, Nov. 2, 1990, pp. 651-657.
Klein, T.M., et al., "High-Velocity Microprojectiles for Delivering Nucleic Acids Into Living Cells," Nature, vol. 327, May 1987, pp. 70-73.
Lai et al., "Structural Characterization of Human Erythropoietin." The Journal of Biological Chemistry, vol. 261, pp. 3116-3121, Mar. 5, 1986.
Latif, F., et al., "Production of Ethanol and Xylitol from Corn Cobs by Yeasts," Bioresource Technology, vol. 77, 2001, pp. 57-63.
Lynd, L.R., et al., "Biocommodity Engineering," Biotechnology Progress, vol. 15, 1999, pp. 777-793.
Mansfield, S.D., et al., "Substrate and Enzyme Characteristics that Limit Cellulose Hydrolysis," Biotechnology Progress, vol. 15, 1999, pp. 804-816.
Montvalvo-Rodriguez, R., et al., "Autohydrolysis of Plant Polysaccharides Using Transgenic Hyperthermophilic Enzymes," Biotechnology and Bioengineering, vol. 2, 2000, pp. 151-159.
Matsumoto, S., et al., "Characterization of Human Glycoprotein (Erythropoietin) Produced in Cultured Tobacco Cells," Plant Molecular Biology, 1995, pp. 1163-1172.
Morassutti, et al., "Production of a Recombinant Antimicrobial Peptide in Transgenic Plants Using a Modified VMA Intein Expressing System," FEBS letters, vol. 519, Nos. 1-3, pp. 141-146 (Apr. 2002).
Murashige, T., et al., A Revised Medium for Rapid Growth and Bio Assays with Tobacco Tissue Cultures, Physiologia Plantarum, vol. 15, 1962, pp. 473-497.
Olsson, L., et al., "Fermentation of lignocellulosic Hydrolysates for Ethanol Production," Enzyme and Microbial Technology, vol. 18, 1996, pp. 312-331.
Parsons, T.J., et al., "Transformation of Poplar by Agrobacterium Tumefaciens," Biotechnology, vol. 4, Jun. 1986, pp. 533-536.
Perler, Francine B., "InBase: The Intein Database," Nucleic Acids Research, 2002, vol. 30, No. 1, pp. 383,384.
Perler, F.B., et al., "Protein Splicing Elements; Inteins and Exteins—A Definition of Terms and Recommended Nomenclature", Nucleic Acids Research, vol. 22, No. 7, Feb. 24, 1993, pp. 1125-1127.
Pietrokovski, Samuel, "Conserved Sequence Features of Inteins (Protein Introns) and Their Use in Indentifying New Inteins and Related Proteins," Protein Science, vol. 3, pp. 2340-2350, Aug. 10, 1994.
Poirier, Yves, "Green Chemistry Yields a Better Plastic," Nature Biotechnology, vol. 17, Oct. 1999, pp. 960-961.
Rocha-Sosa, M., et al., "Both Developmental and Metabolic Signals Activate the Promoter of a Class I Patatin Gene," The EMBO Journal, vol. 8, No. 1, 1989, pp. 23-29.
Chin et al. "Single-column purification of free recombinant proteins using a self-cleavable affinity tag derived from a protein splicing element," Gene: An International Journal of Genes and Genomes, vol. 192, pp. 271-291 (1997).
Yukoh Hiei and Toshihiko Komari, "Improved Protocols for Transformation of Indica Rice Mediated by Agrobacterium tumefaciens," 2006 Plant Cell Tissue and Organ Culture, 2006, 85: 271-283.
Toshihiko Komari, et al., "Vectors Carrying Two Separate T-DNAs for Co-transformation of Higher Plants Mediated by Agrobacterium tumefaciens and Segregations of Trsnformants Free From Selection Markers," The Plant Journal, 199, 10(1): 165-174.

Benjamin N. Gray, et al., "Global and Grain-Specific Accumulation of Glycoside Hydrolase Family 10 Xylanases in Transgenic Maize (*Zea mays*)," Plant Biotechnology Journal, 2011, 9:1100-1108.
Ryan, A.J., et al., Genomic Sequence of a 12S Seed Storage Protein from Oilseed Rape, Nucleic Acids Research, vol. 17, No. 9, 1989, p. 3584.
Minesh Patel, et al., "Transgenic Barley Expressing a Fungal Xylanase Gene in the Endosperm of the Developing Grains," Molecular Breeding, 2000, 6:113-123.
Matthew T. Ziegler, et al., "Accumulation of a Thermostable Endo-1,4-β-D-glucanase in the Apoplast of *Arabidopsis thaliana* Leaves," Molecular Breeding, 2000, 6:37-46.
Thomas Ziegelhoffer, et al., "Expression of Bacterial Cellulase Genes in Transgenic Alfalfa (*Medicago sativa* L.), potato (*Solanum tuberosum* L.) and tobacco (*Nicotiana tabacum*)," Molecular Breeding, 1999, 5: 309-318.
Thomas Ziegelhoffer, et al., "dramatic Effects of Truncation and Sub-cellular Targeting on the Accumulation of recombinant Microbial Cellulase in Tobacco," Molecular Breeding, 2001, 8: 147-158.
Peilong Yang, et al., Expression of Xylanase with High Specific Activity from Streptomyces olivaceoviridis A1 in Transgenic Potato Plants (*Solanum tuberosum* L.), Biotechnology Letters, 2007, 29: 659-667.
Kierston Shill, et al., "Ionic Liquid Pretreatment of Cellulosic Biomass: Enzymatc Hydrolysis and Ionic Liquid Recycle," Biotechnology and Bioengineering, 2011, 108(3): 511-520.
Schreier, P.H., et al., "The Use of Nuclear-Encoded Sequences to Direct the Light-Regulated Synthesis and Transport of a Foreign Protein into Plant Chloroplasts," The EMBO Journal, vol. 4, No. 1, 1985, pp. 25-32.
Goutami Banerjee and John S. Scott-Craig, "Improving Enzymes for Biomass Conversion: A Basic Research Perspective," BioEnergy Research, 2010, 3: 82-92.
Roman Brunecky, et al., "In planta Expression of A. celluloticus Cel5A Endocellulase Reduces Cell Wall Recalcitrance in Tobacco and Maize," Biotechnology for Biofuels, 2011, 4: 1-10.
Mariam B. Sticklen, "Plant Genetic Engineering for Biofuel Production: Towards Affordable Cellulosic Ethanol," Nature Reviews: Genetics, 2008, 9: 433-443.
Yuji Ishida, et al.,"High Efficiency Transformation of Maize (*Zea mays* L.) Mediated by Agrobacterium Transformation," Nature Biotechnology, 1996, 14: 745-750.
K. Herbers, et al., "A Thermostable Xylanase from Clostridium thermocellum Expressed at High Levels in the Apoplast of Transgenic Tobacco Has No Detrimental Effects and Is Easily Purified," Nature Biotechnology, 1995, 13:63-66.
Manuel B. Sainz, "Commercial Cellulosic Ethanol: The Role of Plant-Expressed Enzymes," In Vitro Cellular and Developmental Biology, 2009, 45: 314-329.
Shimamoto, K., et al., Fertile Transgenic Rice Plants Regenerated from Transformed Protoplasts, Nature, vol. 338, Mar. 1989, pp. 274-276.
Hesham Oraby, et al., "Enhanced Conversion of Plant Biomass Into Glucose Using Transgenic Rice-Produced Endoglucanase for Cellulosic Ethanol," Transgenic Research, 2007, 16:739-749.
Tetsuya Kimura, et al., "Stable Expression of a Thermostable Xylanase of Clostridium thermocellum in Cultured Tobacco Cells," Journal of Bioscience and Bioengineering, 2003, 95(4): 397-400.
Bae Hyunjong, et al., Dual Targeting of Xylanase to Chloroplasts and Peroxisomes as a Means to Increase Protein Accumulation in Plant Cells, Journal of Experimental Botany, 2006, 57 (1): 161-169.
Gadab C. Ghosh Biswas, et al., "Expression of Biologically Active Acidothermus cellulolyticus Endoglucanase in Transgenic Maize Plants," Plant Science, 2006, 617-623.
Bernhard Borkhardt, et al., "Autohydrolysis of Plant Xylans by Apoplastic Expression of Thermophilic Bacterial Endo-Xylanases," Plant Biotechnology Journal, 2010, 8: 363-374.
Yuji Ishida, et al., "Agrobacterium—Mediated Transformation of Maize," Nature Protocols, 2007, 2(7):1614-1621.
Yong Woo Park, et al., "Enhancement of Growth and Cellulose Accumulation by Overexpression of Xyloglucanase in Poplar," FEBS Letters, 2004, 564: 183-187.

(56) References Cited

OTHER PUBLICATIONS

Daniel D. Morris, et al., "Cloning of the xynB Gene from Dictyoglomus thermophilum Rt46B.1 and Action of the Gene Product on Kraft Pulp," Applied and Envoronmental Microbiology, 1998, 64(5):1759-1765.

Ingrid Lindh, et al., "Production of the p24 Capsid Protein from HIV-1 Subtype C in *Arabidopsis thaliana* and Daucus carota Using an Endoplasmic Recticulum-Directing SEKDEL sequence in Protein Expression Constructs," Protein Expression and Purification, 2009, 66(1): 46-51.

Elizabeth E. Hood et al., "Subcellular Targeting is a Key Condition for High-Level Accumulation of Cellulase Protein in Transgenic Maize Seed," Plant Biotechnology Journal, 2007, 5: 709-719.

Dylan Dodd and Isaac K. O. Cann, "Enzymatic Deconstruction of Xylan for Biofuel Production," Global Change Biology Bioenergy, 2009, 1(1):2-17.

Shingledecker, et al., "Reactivity of the Cysteine Residues in the Protein Splicing Active Center of the *Mycobacterium tuberculosis* RecA Intein", Mar. 1, 2000, Archives of Biochemistry and Biophysics, vol. 375, No. 1, pp. 138-144.

Sijmons, P.C., et al., Production of Correctly Processed Human Serum Albumin in Transgenic Plants, Biotechnology, vol. 8, Mar. 1990, pp. 217-221.

Smeekens, et al., "Protein Transport into and Within Chloroplasts," Trends in Biochemical Sciences, vol. 15, Feb. 1990, pp. 73-76.

Sreenath, H.K., et al., "Production of Ethanol from Wood Hydrolyzate by Yeasts," Bioresource Technology, vol. 72, No. 3, 2000, pp. 253-260.

Staub, J.M., et al., "High-Yield Production of a Human Therapeutic Protein in Tobacco Chloroplasts," Nature Biotechnology, vol. 18, Mar. 2000, pp. 333-338.

Sun, et al., "Protein Trans-Splicing to Produce Herbicide-Resistant Acetolactate Synthase," Applied and Environmental Microbiology, Mar. 2001, pp. 1025-1029.

Tague, B.W., et al., "A Short Domain of the Plant Vacuolar Protein Phytohemagglutinin Targets Invertase to the Yeast Vacuole," The Plant Cell, vol. 2, Jun. 1990, pp. 533-546.

Taylor, F., et al., "Dry-Grind Process for Fuel Ethanol by Continuous Fermentation and Stripping," Biotechnology Progress, vol. 16, 2000. pp. 541-547.

Tingey, S.V., et al., "Glutamine Synthetase Genes of Pea Encode Distinct Polypeptides Which are Differentially Expressed in Leaves, Roots and Nodules," The EMBO Journal, vol. 6, No. 1, 1987. pp. 1-9.

Ulgen, K.O., et. al., "Bioconversion of Starch Into Ethanol by a Recombinant *Saccharomyces cerevisiae* Strain YPG-AB," Process Biochemistry, vol. 37, 2002, pp. 1157-1168.

Van Den Broeck, G., et al., Targeting of a Foreign Protein to Chloroplasts by Fusions to the Transmit Peptide from the Small Subunit of Ribulose 1,5-Bisphosphate Carboxylase, Nature, vol. 313, Ksmistu 1985, pp. 358-363.

Von Heijne, G., "Towards a Comparative Anatomy of N-Terminal Topogenic Protein Sequences," Journal of Molecular Biology, vol. 189, 1986, pp. 239-242.

Wallace, Carmichael J.A., "The Curious Case of Protein Splicing: Mechanistic Insights Suggested by Protein Semisynthesis," Protein Science, vol. 2, pp. 697-705 (1993).

Wang, et al., "Identification of an Unusual Intein in Chloroplast CipP Protease of Chlamydomonas Eugametos", May 2, 1997, Journal of Biological Chemistry, vol. 272, No. 18, pp. 11869-11873.

Wenzler, H.C., et al., "Analysis of a Chimeric Class-I Patatin-GUS Gene in Transgenic Potato Plants: High-Level Expression in Tubers and Sucrose-Inducible Expressions in Cultured Leaf and Stem Explants," Plant Molecular Biology, vol. 12, 1989, pp, 41-50.

Wood, D.W., et al., "Optimized Single-Step Affinity Purification with a Self-Cleaving Intein Applied to Human Acidic Fibroblast Growth Factor," Biotechnology Progress, vol. 16, 2000, pp. 1055-1063.

Xu, M., et al., "In Vitro Protein Splicing of Purified Precursor and the Identification of Branched Intermediate," Cell, vol. 75, Dec. 31, 1993, pp. 1371-1377.

Xu, M., et al., "The Mechanism of Protein Splicing in its Modulation by Mutation," The EMBO Journal, vol. 15, No. 19, 1996, pp. 5146-5153.

Yang, Jianjun, et al., "Intein-mediated assembly of a functional β-glucuronidase in transgenic plants", PNAS, vol. 100, No. 6, pp. 3513-3518 (2003).

Ziegler, M.T., et al., "Accumulation of Thermostable Endo-1,4-β-D-Glucanase in the Apoplast of *Arabidposis thaliana* Leaves," Molecular Breeding, vol. 6, 2000, pp. 37-46.

Sasaki et al., "GenBank Accession AP003620," Feb. 16, 2008 [online]; downloaded from http://www.ncbi.nlm.nih.gov/nuccore/AP003620 on Mar. 14, 2012.

Sasaki et al., "GenBank Accession AK103463," Dec. 4, 2008 [online]; downloaded from http://www.ncbi.nlm.nih.gov/nuccore/AK103463 on Mar. 14, 2012.

Wilson et al., GenBank Accession AC203259 [online]; downloaded from http://www.ncbi.nlm.nih.gov/nuccore/AC203259 on Mar. 14, 2012.

Gerhard Ritte et al., "The starch-related R1 protein is an alpha-glucan, water dikinase," Proc. Natl Acad Sci USA, 2002, 99(10)7166-7171.

Sean E. Weise et al., "Engineering starch accumulation by manipulation of phosphate metabolism of starch," Plant Biotechnology Journal, 2012, 10(5): 545-554.

Peter A. Stoutjesdijk et al.,"hpRNA-mediated targeting of the *Arabidopsis* FAD2 gene gives highly efficient and stable silencing," Plant Physiology, 2002, 129(4): 1723-1731.

Arjun Krishnan et al.,"Mutant resources in rice for functional genomics of the grasses," Plant Physiology, 2009, 149:165-170.

Bradley J. Till et al., "Discovery of chemically induced mutations in rice by TILLING," BMC Plant Biol., 2007, 7:19.

Neil A. Smith et al., "Total silencing by intron-spliced hairpin RNAs," Nature, 2000, 407:319-320.

Alison M. Smith and Samuel C. Zeeman, "Quantification of starch in plant tissues," Nature Protocols, 2006, 1:1342-1345.

Zheng Zhang et al., "A greedy algorithm for aligning DNA sequences," Journal of Computational Biology, 2000, 7(1-2):203-214.

Gorou Horiguchi, "RNA silencing in plants: a shortcut to functional analysis," Differentiation, 2004, 72(2-3): 65-73.

Tien-Shin Yu et al., "The *Arabidopsis* sex1 Mutant Is Defective in the R1 Protein, a General Regulator of Starch Degradation in Plants, and Not in the Chloroplast Hexose Transporter," The Plant Cell, vol. 13, 1907-1918, Aug. 2001.

P. Alvira et al., "Pretreatment technologies for an efficient bioethanol production process based on enzymatic hydrolysis: A review," Bioresource Technology, vol. 101, 4851-4861, 2010.

Cecilia L Chi-Ham et al., "The intellectual property landscape for gene suppression technologies in plants," Nature Biotechnology, vol. 28, No. 1, 32-36, Jan. 2010.

Gynheung An et al., "Reverse genetic approach for functional genomics of rice," Plant Molecular Biology, vol. 59, 111-123 (2005).

Michelle Christian et al., "Targeting DNA Double-Strand Breaks with TAL Effector Nucleases", Genetics, vol. 186, 757-761, Oct. 2010.

Alessandra Frizzi et al., "Tapping RNA silencing pathways for plant biotechnology," Plant Biotechnology Journal, vol. 8, 655-677, 2010.

Robert M. Horton et al., "Engineering hybrid genes without the use of restriction enzymes: gene splicing by overlap extension." Gene, vol. 77, 61-68, 1989.

Oliver Koetting et al., "Starch-EXCESS4 Is a Laforin-Like Phosphoglucan Phosphatase Required for Starch Degradation in *Arabidopsis thaliana*", The Plant Cell, vol. 21, 334-346, Jan. 2009.

I. Halil Kavakli et al., "Generation, characterization, and heterologous expression of wild-type and up-regulated forms of Arabidopsis thaliana leaf ADP-glucose pyrophosphorylase," Planta, vol. 215, 430-439; 2002.

(56) References Cited

OTHER PUBLICATIONS

Yumiko Obana et al., "Enhanced turnover of transitory starch by expression of up-regulated ADP-glucose pyrophosphorylases in *Arabidopsis thaliana*", Plant Science, vol. 170, 1-11, 2006.

Holger Puchta et al., "Homologous recombination in plant cells in enhanced by in vivo induction of double strand breaks into DNA by a site-specific endonuclease", Nucleic Acids Research, vol. 21, No. 22, 5034-5040, 1993.

Per Sikora et al., "Mutagenesis as a Tool in Plant Genetics, Functional Genomics, and Breeding," International Journal of Plant Genomics, vol. 2011, Article ID 314829, 13 pages, 2011.

T. F. Smith and M. S. Waterman, "Identification of Common Molecular Subsequences," J. Mol. Biol. vol. 147, 195-197, 1981.

Alexander Vainstein et al., "Permanent genome modifications in plant cells by transient viral vectors." Trends in Biotechnology, vol. 29, No. 8, 363-369, Aug. 2011.

Sophie Wehrkamp-Richter et al., "Characterisation of a new reporter system allowing high throughput in planta screening for recombination events before and after controlled DNA double strand break induction", Plant Physiology and Biochemistry, vol. 47, 248-255, 2009.

Mark Stitt and Samuel C Zeeman, "Starch turnover: pathways, regulation and role in growth", Current Opinion in Plant Biology, vol. 15, 282-292, 2012.

Norman Warthmann et al., "Highly Specific Gene Silencing by Artificial miRNAs in Rice", PLoS One, vol. 3, Issue 3, e1829, 1-10, 2008.

David A. Wright et al., "High-frequency homologous recombination in plants mediated by zinc-finger nucleases", The Plant Journal, vol. 44, 693-705, 2005.

J.W.A. Langeveld, et al., "Development Perspectives of the Biobased Economy: a Review," Crop Science, 2010, 50: S131-S151.

J.R. Hess et al., Roadmap for Agricultural Biomass Feedstock Supply in the United States, 2003, DOE/NE-11129.

Miron Abramson, et al., "Plant Cell Wall Reconstruction Toward Improved Lignocellulosic Production and Processability," Plant Science, 2010, 178: 61-72.

Daniel Klein-Marcuschamer, et al., The Challenge of Enzyme Cost in the Production of Lignocellulosic Biofuels, 2012, 109:1083-1087.

Li Zhu, et al., "Structural Features Affecting Biomass Enzymatic Digestability," Bioresource Biotechnology, 2008, 99: 3817-3828.

Charles E. Wyman, et al., "Coordinated Development of Leading Biomass Pretreatment Technologies," Bioresource Biotechnology, 2005, 96:1959-1966.

Nathan Mosier, et al., "Features of Promising Technologies for Pretreatment of Lignocellulosic Biomass," Bioresource Biotechnology, 2005, 96: 673-686.

Mark D. Harrison, et al., "Accumulation of Recombinant Cellobiohydrolase and Endoglucanase in the Leaves of Mature Transgenic Sugar Cane," Plant Biotechnology Journal, 2011, 9: 884-896.

Shyamala Hedge, et al. "Single-Step Synthesis of 4-nitrophenyl Ferulate for Spectrophotometric Assay of Feruloyl Esterases," Analytical Biochemistry, 2009, 387(1): 128-129.

Sandum Fernando, et al., "Biorefineries: Current Status, Challenges, and Future Direction," Energy & Fuels, 2006, 1727-1737.

M. Galbe, et al., "A Review of the Production of Ethanol from Softwood," Applied Microbiology Biotechnology, 2002, 59:618-628.

J.Y. Zhu, et al., "Pretreatment of Woody Biomass for Biofuel Production: Energy Efficiency, Technologies, and Recalcitrance," Applied Microbiology & Biotechnology, 2010, 87(3):847-857.

Jeffrey G. Linger et al., "Heterologous Expression and Extracellular Secretion of Cellulolytic Enzymes of Zymomonas mobilis," Applied and Environmental Mirobiology, 2010, 76(19):6360-6369.

Callista Ransom, et al., "Heterologous Acidothermus cellulolyticus 1,4,β-Endoglucanase E1 Produced Within the Corn Biomass Converts Corn Stover Into Glucose," Applied Biochemistry and Biotechnology, 2007, 36:207-220.

Seung-Hwan Lee, et al., "Enzymatic Saccharification of Woody Biomass Micro/Nanofibrillated by Continuous Extrusion ProcessII: Effect of Hot-Compressed Water Treatment," Bioresource Technology, 2010, 101(24):9645-9649.

Jiele Xu and Jay J. Cheng, "Pretreatment of Switchgrass for Sugar Production with the Combination of Sodium Hydroxide and Lime," Bioresource Technology, 2011, 102(4):3861-3868.

Pradeep Verma, et al., Microwave Assisted Pretreatment of Woody Biomass with Ammonium Molibdate Activated by H2O2, Bioresource Technology, 2011, 102(4):3941-3945.

Jijiao Zeng, et al., "Biological Pretreatment of Wheat Straw by Phanerochaete chrysosporium Supplemented with Inorganic Salts," Bioresource Technology, 2011, 102(3) 3206-3214.

D. Negrotto, et al., "The Use of Phosphomannose-Isomerase As a Selectable Marker to recover Transgenic Maize plants (*Zea mays* L) via Agrobacterium transformation," Plant Cell Reports, 2000, 19 (8): 798-803.

Yukon Hiei, et al., "Efficient Transformation of Rice (*Oryza saliva* L.) mediated by Agrobacterium and sequence analysis of the boundaries of the T-DNA,"The Plant Journal, 1994, 6(2): 271-282.

Lloyd et al., "Leaf starch degradation comes out of the shadows," TRENDS in Plant Science, vol. 10, No. 3, Mar. 2005 (8 pages).

Xie et al., accession No. AM181054 (also known as Q2P9Q1) (2 pages), Jan. 9, 2006.

Guo et al., "Protein tolerance to random amino acid change," PNAS, vol. 101, No. 25, Jun. 22, 2004 (pp. 9205-9210).

Tokuda et al., "Metazoan cellulase genes from termites: intron/exon structures and sites of expression," Biochimica et Biophysica Acta 1447 (1999) (pp. 146-159).

GenBank accession No. BAA33708, first available Oct. 8, 1999 (1 page).

Streatfield et al., "Corn as a production system for human and animal vaccines," Vaccine 21 (2003) (pp. 812-815).

Christian et al, "The yield and composition of switchgrass and coastal panic grass grown as a biofuel in Southern England," Bioresource Technology 83 (2002) (pp. 115-124).

Sivamani et al., "Expression enhancement of a rice polyubiquitin gene promoter," Plant Molecular Biology (2006) 60:225-239.

Belknap et al., "pBINPLUS/ARS: an improved plant transformation vector based on pBINPLUS," BioTechniquies 44:753-756 (May 2008).

Liu et al., "Enhanced enzymatic hydrolysis and structural features of corn stover by FeCl3 pretreatment", Bioresource Technology 100 (2009) p. 5853-5858.

Chen et al., "Herbicide resistance from a divided EPSPS protein: the split Synechocytis DnaE intein as an in vivo affinity domain", Gene 263 (2001) p. 39-48.

Shen et al., "Engineering a thermoregulated intein-modified xylanase into maize for consolidated lignocellulosic biomass processing" Nature Biotechnology, vol. 30 (11); Nov. 2012; pp. 1131-1138.

Asatsuma Satoru et al., "Involvement of alpha-amylase I-1 in starch degradation in rice chloroplasts", Plant and Cell Physiology, vol. 46, No. 6 (Jun. 2005) pp. 858-869.

Wu et al., "Modes of intercellular transcription factor movement in the *Arabidopsis* apex," The Company of Biologists Ltd. (2003) (130) 3735-3745.

Waigmann et al., "Direct functional assay for tobacco mosaic virus cell-to-cell movement protein and identification of a domain involved in increasing plasmodesmal permeability," Proc. Nat'l Acad. Sci. USA, vol. 91, 1433-1437, Feb. 1994.

Wolf et al., "Movement protein of Tobacco Mosaic Virus Modifies Plasmodesmatal Size Exclusion Limit," Science, New Series, vol. 246 (4928), 377-379, Oct. 1989.

Chen et al., "Identification of evolutionarily conserved amino acid residues in homeodomain of KNOX proteins for intercellular trafficking," Plant Signaling & Behavior 9, e28355, Feb. 2014 Landes Bioscience.

Edwards et al., "Compartmentation of photosynthesis in cells and tissues of C4 plants," Journal of Experimental Botany, vol. 52 (356) 577-590, Apr. 2001.

(56) References Cited

OTHER PUBLICATIONS

Oparka et al., "Simple, but Not Branched, Plasmodesmata Allow the Nonspecific Trafficking of Proteins in Developing Tobacco Leaves," Cell, vol. 97, 743-754, Jun. 1999.

Crawford and Zambryski, "Subcellular localization determines the availability of non-targeted proteins to plasmodesmatal transport," Current Biology 2000, (10), 1032-1040, Aug. 2000.

Goodwin, "Molecular size limit for movement in the symplast of the Elodea leaf," Planta, (1983) (157), 124-130.

Sowinski et al., "On the mechanism of C4 photosynthesis intermediate exchange between Kranz mesophyll and bundle sheath cells in grasses," Journal of Experimental Botany, vol. 59 (6), 1137-1147, Mar. 2008.

Echeverria and Boyer, "Localization of Starch Biosynthetic and Degradative Enzymes in Maize Leaves," American Journal of Botany, vol. 73 (2), 167-171, Feb. 1986.

Majeran, et al, "Functional Differentiation of Bundle Sheath and Mesophyll Maize Chloroplasts Determined by comparative Proteomics," The Plant Cell, vol. 17, 3111-3140, Nov. 2005.

Stahl and Simon, "Gated communities: apoplastic and symplastic signals converge at plasmodesmata to control cell fates," Journal of Experimental Botany, (2013) vol. 64 (17), 5237-5241.

Matsuoka et al, "The promoters of two carboxylases in a C4 plant (maize) direct cell-specific, light-regulated expression in a C3 plant (rice)," The Plant Journal (1994) 6(3), 311-319.

Sattarzadeh et al., "Transgenic maize lines with cell-type specific expression of fluorescent proteins in plastids," Plant Biotechnology Journal (2010) 8, pp. 112-125.

Gudesblat et al., "Guard cell-specific inhibition of *Arabidopsis* MPK3 expression causes abnormal stomatal responses to abscisic acid and hydrogen peroxide," New Phytologist (2007) 173: 713-721.

Xu et al., "RNA Interference of Plant MAPK Cascades for Functional Studies," Methods in Molecular Biology, vol. 1171, pp. 91-103 (2014).

Grennan Aleel K., "Regulation of Starch Metabolism in *Arabidopsis* Leaves", Plant Physiology, vol. 142, No. 4, (Dec. 2006) pp. 1343-1345.

Smith Alison M., et al., "Starch mobilization in leaves", Journal of Experimental Botany, vol. 54, No. 382 (Jan. 1, 2003) pp. 577-583.

Scheidig Andreas et al., "Downregulation of a chloroplast-targeted beta-amylase leads to a starch-excess phenotype in leaves", Plant Journal, vol. 30, No. 5 (Jun. 2002) pp. 581-591.

Niittyla Totte, et al., "A previously unknown maltose transporter essential for starch degradation in leaves", Science, vol. 303, No. 5654 (Jan. 2, 2004) pp. 87-89.

Syngenta Participations AG, "International Search Report", PCT/US2008/082336, Feb. 17, 2009.

Syngenta Participations AG, "Written Opinion", PCT/US2008/082336, Feb. 17, 2009.

UNIPROT, P77853_DICTH, pp. 1-4 (Feb. 1, 1997).

Sakon et al., accession No. GUN1_ACIC1 (3 pages), 1996.

Zeidler et al. 2004, Temperature Sensitive Control of Protein Activity by Conditionally Splicing Intein, Nat Biotech 22: 871-876.

\* cited by examiner

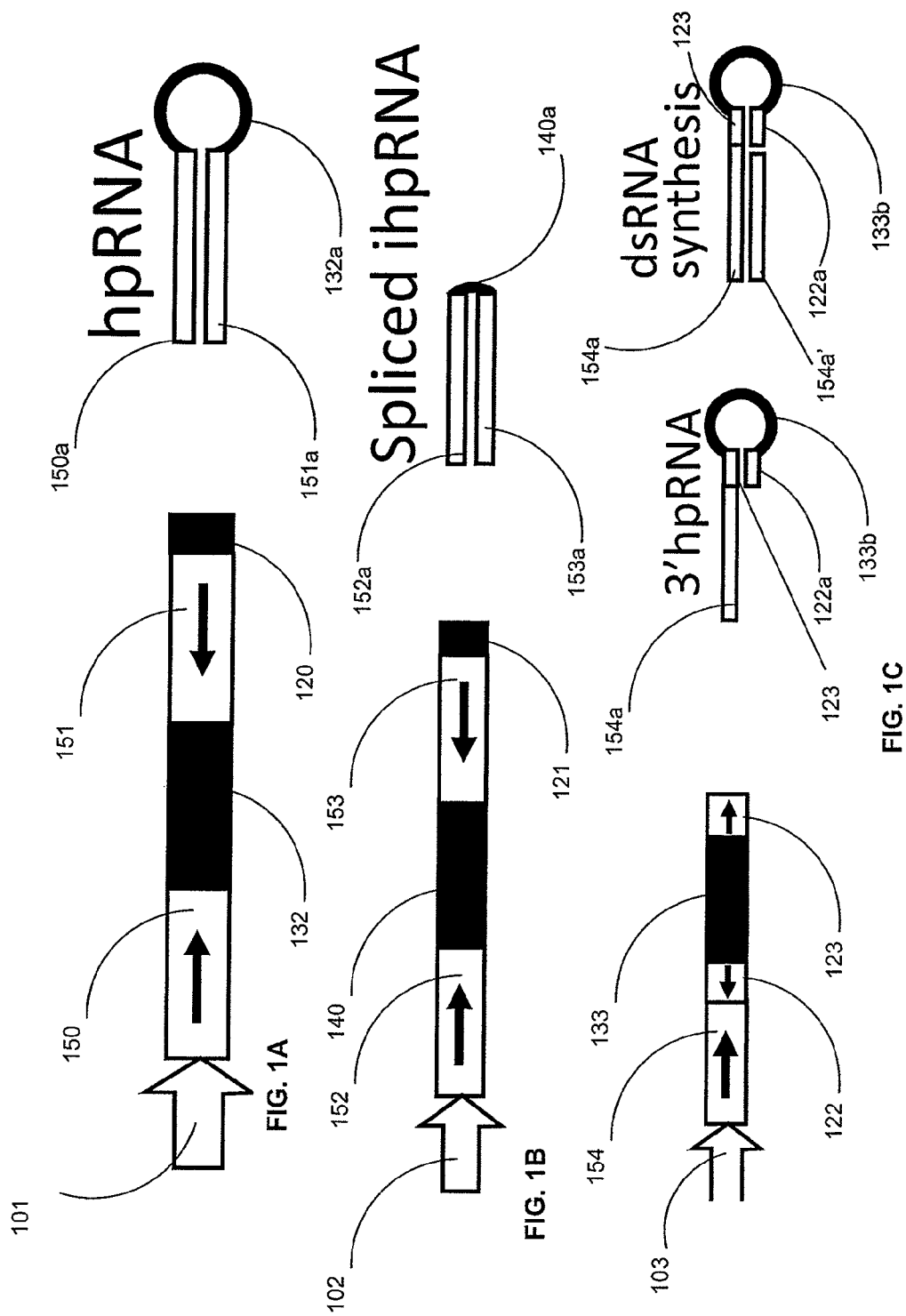

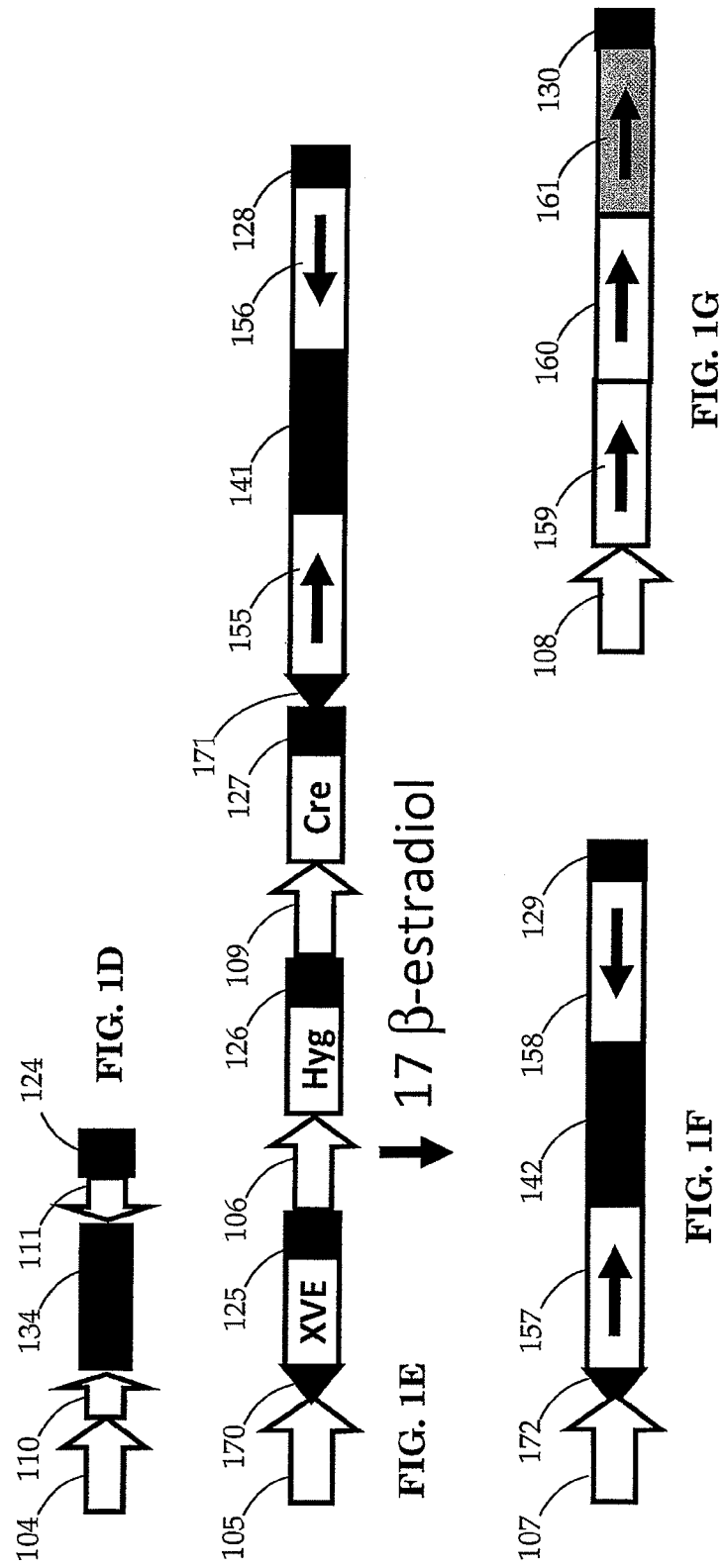

gb|EU908574.1| Solanum lycopersicum glucan water dikinase
(GWD) mRNA, complete cds
Length=4398

Score = 292 bits (158), Expect = 2e-82
Identities = 403/519 (77%), Gaps = 26/519 (5%)
Strand=Plus/Plus

```
Query  49    TGGAATTTTTGTTTGGATTAGGTTCATGGCTACAAGGCAACTAATATGGAACAAGAACTA  108
             ||||||| |||| ||||| |||||||||||||||||||| || |||||||||||| ||||
Sbjct  1803  TGGAATTCTTGTATGGATGAGGTTCATGGCTACAAGGCAGCTGATATGGAACAAAACTA  1862

Query  109   CAATGTGAAGCCACGTGAGATAAGCAAAGCACAAGATAGGTTTACAGATGAT-CTTG-AG  166
             || ||||| ||||||||| |||||||| ||| || || ||   ||||| || ||||  | 
Sbjct  1863  TAACGTGAAACCACGTGAAATAAGCAAGGCTCAGGACAGACTTACAGA-CTTGC-TGCAG  1920

Query  167   AAT-ATGTACAGAACTTACCCACAATATCAG-GAGATC-TTAAGAATGATAATGTCTGCT  223
             |||  | ||  | | || || ||  ||| || | ||||  ||||| |||| ||
Sbjct  1921  AATGCT-TTCACCAGTCATCCTCAGTA-CCGTGA-AACTTTGCGGATGATTATGTCAACT  1977

Query  224   GTTGGTCGGGGAGGTGAAGGTGATGTTCGTCAACGCATTCGTGATGAGATATTAGTAATC  283
             ||||| || |||||||||||  ||||| ||| | || ||| | || || || || || |||
Sbjct  1978  GTTGGACGTGGAGGTGAAGGGGATGTAGGACAGCGAATTAGGGACGAAATTTTGGTCATC  2037

Query  284   CAGA-GAAATAATGACTGCAAAGGTGGAATGATGGAGGAGTGGCACCAGAAACTGCACAA  342
             ||||  ||| |||||||||||| ||||| ||||||||| ||||||||| |||| || |||
Sbjct  2038  CAGAGGAAA-AATGACTGCAAGGGTGGTATGATGGAAGAATGGCATCAGAAATTGCATAA  2096

Query  343   CAATACAAGCCCAGATGATGTAGTGATCTGCCAGGCCCT-ACTTGATTATATCAAGAGTG  401
             || || || || |||||||||||||| || ||||| |||  || || || ||||||||||
Sbjct  2097  TAACACTAGTCCTGATGATGTTGTGATCTGTCAGGCACTGA-TTGACTACATCAAGAGTG  2155

Query  402   ATTTTGATATTGGTGTTTACTGGGACACCTTGAAAAAAGAT-GGTATAACAAAAGAGCGT  460
             |||||||||||||||||| | |||| ||| ||||| | ||  || || || |||||||||
Sbjct  2156  ATTTTGATATTGGTGTTTATTGGAAAACCCTGAATGA-GAACGGAATTACAAAAGAGCGT  2214

Query  461   CTATTGAGCTATGATCGACCGATTCATTCAGAGCCAAATTTCAGGAGTGA-A-CAGAAAG  518
             || |||||| ||||| || ||  | ||||||||||| || |||||| || || | ||||
Sbjct  2215  CTTTTGAGTTATGACCGTGCTATCCATTCTGAACCAAATTTTAG-AG-GAGATCA-AAAG  2271

Query  519   -ATGG-CTTACTCCGTGACTTGGG-CAATTATATGAGAA  554
              |||| |||   | ||||| || || |||||||||||
Sbjct  2272  GATGGTCTTT-TGCGTGATTTAGGTCACT-ATATGAGAA  2308
```

FIG. 7

Multiple Species Alignments

```
OsGWD       TGGAATTTTTGTTTGCATTAGGTTCATGGCTACAAGGCA
SbGWD       TGGACTTTTTGTTTGGATTAGGTTCATGGCTACCAGGCA
ZmGWD       NNNNNNNNNNNNNNNNNNNNGATTCATGGCTACCAGGCA
SlGWD       TGGAATTCTTGTATGGATGAGGTTCATGGCTACAAGGCA dgGWDup2    TGGAATTYTTGTWTGGATKAGRTTCATGGCTACMAGGCA

OsGWD       AGAGCGTCTATTGAGCTATGATCGACCGATTCATTCAGAGCC
SbgWD       AGAGCGTCTCTTGAGCTATGATCGTGCTATTCATTCAGAACC
ZmGWD       AGAGCGTCTCTTGAGCTATGATCGTGCTATTCATTCAGAACC
SlGWD       AGAGCGTCTTTTGAGTTATGACCGTGCTATCCATTCTGAACC dgGWDdown2  AGAGCGTCTHTTGAGYTATGAYCGWSCKATYCATTCWGARCC
```

FIG.10

METHODS AND COMPOSITIONS FOR PROCESSING BIOMASS WITH ELEVATED LEVELS OF STARCH

CROSS REFERENCE TO RELATED APPLICATION

This application is a continuation-in-part of U.S. patent application Ser. No. 13/806,654, filed Mar. 19, 2013, which is a 35 U.S.C. 371 National Stage Application of International Patent Application No. PCT/US2011/041991, filed Jun. 27, 2011; and claims the benefit of U.S. Provisional Patent Application No. 61/358,720, filed Jun. 25, 2010; and claims the benefit of U.S. Provisional Application No. 61/726,301, filed Nov. 14, 2012; all of which are incorporated herein by reference as if fully set forth.

GOVERNMENT SUPPORT STATEMENT

This invention was made at least in part with government support under award number 2009-10001-05118 awarded by the U.S. National Institute of Food and Agriculture, USDA. The government has certain rights in the invention.

The Sequence Listing titled "Sequence_Listing," having a file size of about 1,236,683 bytes, created on Mar. 8, 2013 and filed herewith is incorporated herein by reference as if fully set forth.

FIELD OF INVENTION

The disclosure herein relates to isolated nucleic acids, genetic constructs and vectors for engineering plants with elevated levels of vegetative starch and expressing polysaccharide degrading enzymes, and genetically engineered plants. The disclosure also relates to methods of agricultural processing and preparing animal feed using the genetically engineered plants.

BACKGROUND

Glucose is a simple sugar that can be used in a variety of food, feed, and chemical applications. However, glucose availability and cost have recently become a limiting factor in the demand for an inexpensive biofuel feedstock and sustainable animal feed. Demand for corn and sugarcane has increased the price of this commodity significantly. Starch is a large polymer composed of repeating glucose residues linked via α-1,4 and α-1,6 bonds (Stitt & Samuel C Zeeman 2012). Starch is a superior source of glucose because of it's simple molecular structure (α-1-4, and α-1-6 glucose linkages) and the relative ease with which these bonds are accessed and hydrolyzed by inexpensive and highly effective enzymes (e.g.; α-amylase and glucoamylase). Starch derived from plant materials can be readily converted into glucose either in the digestive tracts of animals (feed applications) or biochemically (for example, via acid hydrolysis or enzymatic hydrolysis). Hydrolysis of high-starch plant tissues like grain provides relatively pure glucose that is effectively transformed into meat or chemical end-products.

Glucose can also be derived from other plant-produced polymers, such as cellulose, β-glucan, or xyloglucans. However, the processes for releasing the glucose from these polymers are generally much less efficient; they are less easily digested by ruminant and monogastric animals, and chemical means of releasing the glucose typically involve harsh chemical treatments followed by hydrolysis with expensive enzyme cocktails (Alvira et al. 2010).

Sucrose, a soluble storage carbohydrate, is also a plant derived feedstock molecule that is readily utilized by fermentative organisms. Cropping and processing systems that use sucrose feedstocks, such as sugarbeets and sweet sorghum, are constrained by narrow harvest windows and storage and stability limitations. Sweet sorghum must be processed similarly to sugarcane, within days of its harvest to limit microbial fermentation of the sucrose due to the high moisture content in the harvested materials (spoilage). Campaign periods reduce the overall capital effectiveness of dedicated processing facilities.

Lignocellulosic substrates are less attractive feedstocks because of processing difficulties. Lignocellulosic biomass contains a mixture of hexoses and pentoses and their recalcitrance to hydrolysis (crystallinity, and cross-linking to lignin) makes digestion and cost effective degradation into useable sugars difficult. In biofuels production, expensive pretreatments are being developed to aid in complete hydrolysis of lignocellulosic materials. Full utilization of the resultant mixtures of sugars for fuel and chemical production also requires that specialized fermentation organisms transform the resulting sugars into final products, such as ethanol, butanol, succinic acid, and other chemicals.

SUMMARY

In an aspect, the invention relates to a genetically engineered plant. The genetically engineered plant comprises a first isolated nucleic acid that encodes a product that inactivates or inhibits expression of at least one gene encoding a protein involved in mobilization of starch in a plant. The genetically engineered plant also comprises a second isolated nucleic acid that encodes at least one polysaccharide degrading enzyme. Upon the expression of the first nucleic acid, the genetically engineered plant has an altered level of vegetative starch compared to the level of vegetative starch in a non-genetically engineered plant having the same genetic background as the genetically engineered plant but lacking the first isolated nucleic acid.

In an aspect, the invention relates to a genetic construct. The genetic construct includes a first isolated nucleic acid that encodes a product that inactivates or inhibits expression of at least one gene encoding a protein involved in mobilization of starch in a plant. The genetic construct also includes a second isolated nucleic acid that encodes at least one polysaccharide degrading enzyme.

In an aspect, the invention relates to a method of agricultural processing or preparing animal feed. The method comprises providing a genetically engineered plant. The genetically engineered plant comprises a first isolated nucleic acid that encodes a product that inactivates or inhibits expression of at least one gene encoding a protein involved in mobilization of starch in a plant. The genetically engineered plant also comprises a second isolated nucleic acid that encodes at least one polysaccharide degrading enzyme. Upon the expression of the first nucleic acid, the genetically engineered plant has an altered level of vegetative starch compared to the level of vegetative starch in a non-genetically engineered plant.

BRIEF DESCRIPTION OF THE DRAWINGS

The following detailed description of the preferred embodiments of the present invention will be better understood when read in conjunction with the appended drawings. For the purpose of illustrating the invention, there are shown in the drawings particular embodiments. It is understood, however, that the invention is not limited to the precise arrangements and instrumentalities shown. In the drawings:

FIGS. 1A-G illustrate strategies for expressing interfering RNAs in transgenic plants.

FIG. 7 illustrates sequence comparison between the Query (top sequence), a portion of GWD2 [SEQ ID NO: 181], derived from the rice glucan water dikinase gene, and the Sbjct (bottom sequence), a portion of the GWD gene from tomato (*Solanum lycopersicon*) [SEQ ID NO: 182].

FIG. 10 illustrates alignment of excerpts from the GWD genes of rice (OsGWD) [SEQ ID NOS: 196 and 200], sorghum (SbGWD) [SEQ ID NOS: 197 and 201], maize (ZmGWD) [SEQ ID NOS: 198 and 202], and tomato (SlGWD) [SEQ ID NOS: 199 and 203]. Primers dgGWup2 [SEQ ID NO: 204] and dgGWdown2 [SEQ ID NO: 205] are also illustrated.

DETAILED DESCRIPTION OF THE PREFERRED EMBODIMENTS

Figure 2:
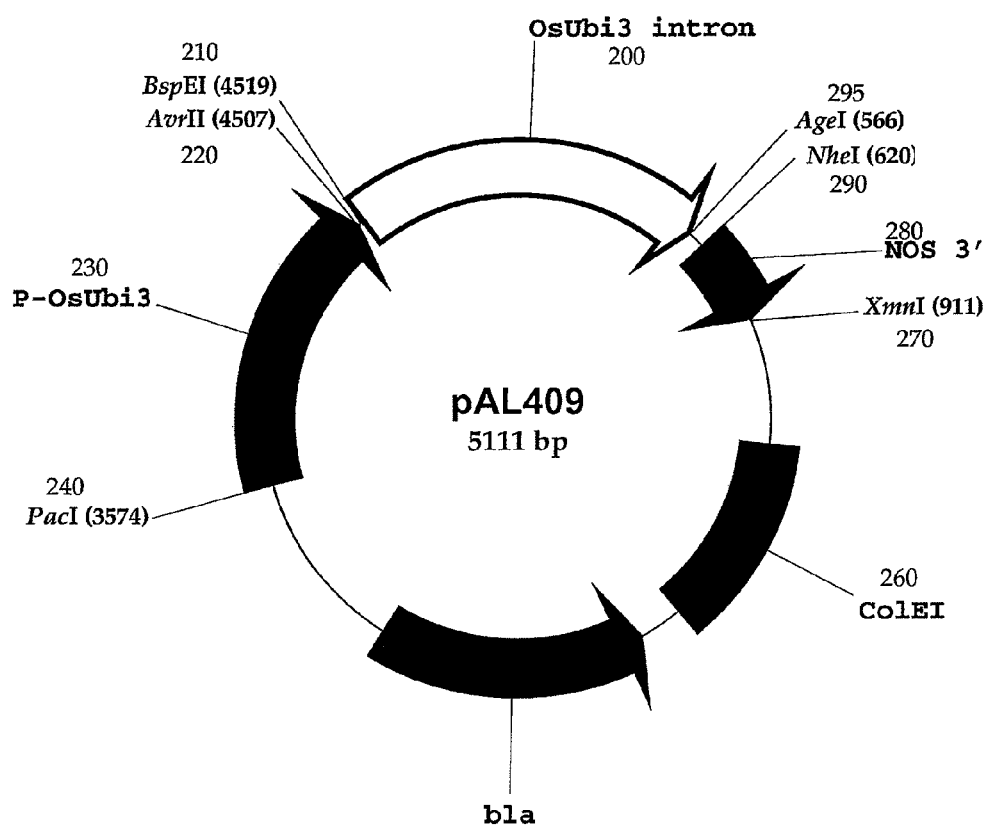
FIG. 2 illustrates an intermediate RNAi vector, pAL409.

Certain terminology is used in the following description for convenience only and is not limiting.

"Isolated nucleic acid," "isolated polynucleotide," "isolated oligonucleotide," "isolated DNA," or "isolated RNA" as used herein refers to a nucleic acid, polynucleotide, oligonucleotide, DNA, or RNA separated from the organism from which it originates or from the naturally occurring genome, location, or molecules with which it is normally associated, or is a nucleic acid that was made through a synthetic process.

"Isolated protein," "isolated polypeptide," "isolated oligopeptide," or "isolated peptide" as used herein refers to a protein, polypeptide, oligopeptide or peptide separated from the organism from which it originates or from the naturally occurring location, or molecules with which it is normally associated.

As used herein, "variant" refers to a molecule that retains a biological activity that is the same or substantially similar to that of the original sequence. The variant may be from the same or different species or be a synthetic sequence based on a natural or prior molecule.

Nucleic acids, nucleotide sequences, proteins or amino acid sequences referred to herein can be isolated, purified, synthesized chemically, or produced through recombinant DNA technology. All of these methods are well known in the art.

As used herein, "operably linked" refers to the association of two or more biomolecules in a configuration relative to one another such that the normal function of the biomolecules can be performed. In relation to nucleotide sequences, "operably linked" refers to the association of two or more nucleic acid sequences in a configuration relative to one another such that the normal function of the sequences can be performed. For example, the nucleotide sequence encoding a presequence or secretory leader is operably linked to a nucleotide sequence for a polypeptide if it is expressed as a preprotein that participates in the secretion of the polypeptide; a promoter or enhancer is operably linked to a coding sequence if it affects the transcription of the coding sequence; and a nucleic acid ribosome binding site is operably linked to a coding sequence if it is positioned so as to facilitate binding of the ribosome to the nucleic acid.

The words "a" and "one," as used in the claims and in the corresponding portions of the specification, are defined as including one or more of the referenced item unless specifically stated otherwise. This terminology includes the words above specifically mentioned, derivatives thereof, and words of similar import. The phrase "at least one" followed by a list of two or more items, such as "A, B, or C," means any individual one of A, B or C as well as any combination thereof.

Increasing the starch content of biomass can increase the energy content (calories) in animal feed or improve glucose extraction from biomass for the production of ethanol or other biochemicals.

A strategy for increasing glucose availability in plant derived biomass that is to be used as animal feed or chemical feedstock would be to cause the plants to accumulate additional starch. Such additional starch would both augment the total amount of glucose present in the biomass and make a greater portion of that glucose easily-extracted. To increase the amount of starch that accumulates in biomass, particularly in vegetative (non-seed) parts of the plant, the normal processes by which plants synthesize and turn over vegetative starch may be modulated.

Plants typically synthesize starch in vegetative tissues during the daytime, while at night they degrade the starch to mobilize the resulting sugar in order to support the energy needs of the plant. Vegetative plant cells express a series of enzymes to initiate mobilization of transitory starch during the nighttime (Stitt & Samuel C Zeeman 2012). Among these are Glucan Water Dikinase ("GWD"), which phosphorylates the starch polymer, and Phosphoglucan Water Dikinase (PWD), which further phosphorylates the starch. These steps in starch turnover make the starch polymer accessible to subsequent starch degrading enzymes. A number of starch degrading enzymes can then bind to the phosphorylated polysaccharide, but depolymerization (hydrolysis) of the starch granule does not progress efficiently until the starch polymer is dephosphorylated through the action of enzymes such as the dual-specificity protein phosphatase (DSP) or other phosphoglucan phosphatases. Subsequently, enzymes such as beta amylases (BAM), isoamylases (such as ISA3), alpha amylases (AMY), debranching enzymes (DBE), disproportionating enzymes (DPE) and limit dextrinases, convert the starch polymer to linear glucans, short oligosaccharides such as maltose, and glucose. To develop biomass that has more utility and higher value as a feed product (e.g., when formulated as a feed ration or when used in silage) or as an industrial feedstock (e.g., to provide glucose for the fermentative production of ethanol or other biochemicals), an increased starch accumulation was sought in vegetative tissues by reducing the expression or activity of key enzymes involved in the turnover of transitory starch.

An embodiment provides a method for alteration in the amount of starch that accumulates in vegetative tissues of plants by inhibiting the activity of enzymes that are normally responsible for mobilizing vegetative starch (hereinafter referred to as "Green Starch" or "vegetative starch") during day/night cycles. Isolated nucleic acids are provided for alteration in the amount of starch that accumulates in vegetative tissues of plants by inhibiting the activity of enzymes that are normally responsible for mobilizing Green Starch. Genetically engineered plants are provided, which include nucleic acids for alteration in the amount of starch that accumulates in vegetative tissues of plants by inhibiting the activity of enzymes that are normally responsible for mobilizing Green Starch. Any plant can be provided as the genetically engineered plant.

In an embodiment, plants may be also genetically engineered to express polysaccharide degrading enzymes. Genetically engineered plants having elevated levels of vegetative starch may also express one or more polysaccharide degrading enzymes. Polysaccharide degrading enzymes may be starch degrading enzymes. Starch degrading enzymes may be but are not limited to amylases (BAM), isoamylases (such as ISA3), alpha amylases (AMY), debranching enzymes (DBE), disproportionating enzymes (DPE), limit dextrinases, glucoamylases, glucotransferases, glucosidases or invertases. Polysaccharide degrading enzymes may be cell wall degrading enzymes (CWDEs) or modified CWDEs. The modified forms may be intein modified CWD proteins. Intein modified enzymes and conditions for inducing splicing of the inteins, which could be used as activation conditions, were described in U.S. application Ser. No. 10/886,393 filed Jul. 7, 2004 and PCT/US10/55746 filed Nov. 5, 2010, and PCT/US10/55669 filed Nov. 5, 2010 and PCT/US10/55751 filed Nov. 5, 2010, which are incorporated herein by reference as if fully set forth. One or more polysaccharide degrading enzyme may be but is not limited to an enzyme selected from XynA: Beta-1,4-xylanase 229B from *Dictyoglomus thermophilum* (Uniprot accession P77853); XynB: Endo-1,4-beta-xylanase from *Thermomyces lanuginosus* (Uniprot accession O43097); EGA: Endo-beta 1,4-endoglucanase from *Nasutitermes takasagoensis* (Uniprot accession O77044); EGB: Endo-beta 1,4-endoglucanase from *Acidothermus cellulolyticus* (Uniprot accession P54583); AccA: Feruloyl esterase A from *Apergillus niger* (Uniprot accession O42807); AccB: Feruloyl esterase B from *Aspergillus niger* (Uniprot accession number Q8WZI8); AccA/B: Feruloyl esterase A and Feruloyl esterase B from *Aspergillus niger*; EGC: Endo-beta 1,4-endoglucanase from *Rhodothermus marinus* (Uniprot accession O33897); P40942: Beta-1,4-xylanase from *Clostridium stercorarium* F9 (Uniprot accession number P40942); P40943: Beta-1,4-xylanase from *Geobacillus stearothermo-*

*philus* T-6 (*Bacillus stearothermophilus*; Uniprot accession number P40943); O30700: Beta-1,4-xylanase from *Bacillus* sp. NG-27 (Uniprot accession number O30700); CBHA: cellobiohydrolase A from *Clostridium thermocellum* (Uniprot accession number O68438); CBHB: cellobiohydrolase B (SYT BD22308); or XynE: xylanase (EU591743).

Embodiments herein provide for harvesting plants having elevated levels of starch and/or in planta polysaccharide degrading enzymes for use as a feedstock in agricultural processing. Genetically engineered plant biomass expressing polysaccharide degrading enzymes may not require harsh pretreatments to improve cellulose cell wall accessibility to exogenous enzymes. Methods and compositions for consolidated pretreatment and hydrolysis of plant biomass expressing cell wall degrading enzymes were described in U.S. patent application Ser. No. 13/414,627, filed Mar. 7, 2012; and International Patent Application No. PCT/US2012/028132, filed Mar. 7, 2012, which are incorporated herein by reference as if fully set forth.

In an embodiment, animal feed applications including increased levels of starch in vegetative tissues are provided. Easily-fermentable sugars available in a fermentation process may be provided by embodiments herein. Production of biofuels may be enhanced by providing easily-fermentable sugars. Methods of providing easily fermentable sugars and methods of enhancing production of biofuels are provided as embodiments herein.

Crops with elevated levels of vegetative starch have a variety of uses and utilities. In an embodiment, biomass from plants that accumulate elevated levels of vegetative starch relative to wild type plants are provided. These plants may have added value as feedstocks for fermentation processes or animal feed applications. For example, in a typical cellulosic process, polysaccharides such as cellulose and hemicelluloses that are present in the biomass are hydrolyzed to simple sugars, which may then be fermented to ethanol, butanol, isobutanol, fatty acids, or other hydrocarbons by microorganisms. Because of the recalcitrance of the biomass, the release of the simple sugars from polymers such as cellulose and hemicelluloses often requires the use of harsh pretreatment conditions and hydrolysis with relatively expensive mixtures of enzymes. In contrast, any starch that is present in the biomass represents an additional source of simple sugars (namely, glucose), which can be released very easily and much less expensively with either dilute acid treatments or hydrolysis by amylases, which are currently available and much less expensive than the enzymes required for the digestion of cellulose and hemicelluloses. As a result, any increase in the amount of starch present in the biomass will simultaneously increase the amount of fermentable sugar that can be recovered (and therefore the amount of ethanol, butanol, etc. that can be made) with only a disproportionately small increase in process costs (i.e. addition of an inexpensive amylase or acid pretreatment). Similarly, biomass that contains elevated levels of starch may have greater value in forage applications, where the plant material is fed to livestock. Again, the excess starch present in this material is more easily digested by most animals than is the cellulosic material, providing more energy per unit biomass than biomass with ordinary levels of starch. Embodiments include utilizing a transgenic plant as set forth herein for any of these methods.

Methods herein, including those in the previous paragraph, may include modifying plants to create genetically engineered plants, growing the genetically engineered plants, harvesting the plants and either processing them for animal feed applications as one would other forage crops, or dry them and treat them for use in fermentation processes similar to the manner of treatment that is used in cellulosic processes but with the addition of a treatment such as acid hydrolysis or amylase digestion to hydrolyze the starch to its component sugars. Any one step, set of steps, or all the steps set forth in this paragraph may be provided in a method herein.

Genes to target for Green Starch alteration were identified. Any enzyme, protein or nucleic acid involved in starch metabolism may be targeted for alteration of Green Starch levels. In an embodiment, alteration is accomplished by suppression of gene expression of genes related to Green Starch. In an embodiment, alteration is an increase in the amount of Green Starch. Particular enzymes that may be targets include but are not limited to Glucan Water Dikinase (also known as GWD, R1, sex1); Phosphoglucan Water Dikinase (also known as PWD); Dual Specificity Protein Phosphatase (also known as DSP, sex4); β-amylase (BAM), isoamylase (also known as ISA3), limit dextrinases (also known as LDA); disproportionating enzyme; and other debranching enzymes. GWD phosphorylates starch, which is then susceptible to starch degrading enzymes. PWD phosphorylates starch, and may be dependent upon prior action by GWD by episatsis. DSP is regulatory, and may activate starch degrading enzymes. DSP may also phosphorylate starch. Also, DSP is suspected of having endo-amylase activity, which may be synergistic with β-amylase and isoamylase starch mobilization. BAM (but not α-amylase) and ISA3 are involved in mobilizing vegetative starch. BAM activity depends on GWD, and ISA3 activity depends on BAM.

A number of strategies are available for interfering with the expression or accumulation of enzyme activities in plants. Among these are antisense RNA, co-suppression, and RNA interference (Frizzi & Huang 2010 and Chi-Ham et al. 2010), mutagenesis and screening strategies such as TILLING (Sikora et al. 2011), T-DNA insertion and transposon-based mutagenesis (An et al. 2005), genome editing strategies involving nucleases such as zinc-finger nucleases (Wright et al. 2005), TAL effector nucleases (Christian et al. 2010), or intein-derived meganucleases (Wehrkamp-Richter et al. 2009). The references cited are incorporated herein by reference as if fully set forth.

A number of genome editing strategies have been developed to introduce stable changes that either completely or partially (that is, silence or attenuate) block expression of genes encoding enzymes that are involved in mobilization of transitory starch. Among these are deleting critical regions in the promoters, coding sequences, or terminator sequences of the genes or changing or deleting key amino acid residues in enzyme catalytic domain to reduce the activity of the enzyme that is expressed. Changes can be introduced by introducing a transgene into transgenic plants that expresses a recombinant nuclease that is designed to cleave the target gene as described previously (Puchta et al. 1993; Wright et al. 2005 and Wehrkamp-Richter et al. 2009, which are incorporated herein by reference as if fully set forth). The target gene can itself be a separate transgene or an endogenous gene that is native to the plant. Once expressed, the nuclease will introduce double stranded DNA breaks in the target sequence, for example, deleting a short segment that then may be partially repaired by the cell's DNA repair mechanisms, leaving a lesion within the target gene. Once the target gene has been cleaved, the nuclease gene is no longer needed. If the nuclease gene was itself introduced as part of a separate stable transgene, then the nuclease transgene may have integrated into a different site within the genome of the host organism. In such cases, the nuclease gene can be eliminated from the plants via genetic segregation and selection. Alternatively, the nuclease gene can be introduced as a transient expression system, for example as part of the genome of a non-integrating virus as described by Vainstein et al. 2011, which is incorporated herein by reference as if fully set forth. In either case, if the alterations (deletions) to the target gene are carried by cells in the germline, progeny of the modified plants will carry the altered target genes, and they will not express fully functional enzyme from that target gene.

In an embodiment, targets may be suppressed using RNAi suppression of gene expression. RNAi constructs are provided to suppress gene expression of target proteins. The target proteins may be enzymes. The target enzyme may be selected from an enzyme involved in Green Starch mobilization. RNAi constructs suppressing at least one of GWD, PWD, DSP, BAM, isoamylase, LDA, disproportionating enzyme and other debranching enzymes are provided.

A number of strategies have been developed for expressing RNAi in transgenic plants. See, for example, Horiguchi G., RNA silencing in plants: a shortcut to functional analysis (2004) Differentiation 72(2-3): 65-73, which is incorporated by reference herein as if fully set forth. See also Smith N A, Singh S P, Wang B, Stoutjesdijk P A, Green A G, Waterhouse P M, Total silencing by intron-spliced hairpin RNAs (2000) Nature 407:319-20; Stoutjesdijk P A, Singh S P, Liu Q, Hurlstone C J, Waterhouse P A, Green A G hpRNA-mediated targeting of the *Arabidopsis* FAD2 gene gives highly efficient and stable silencing (2002) Plant Physiol. 129(4): 1723-31, which are incorporated by reference herein as if fully set forth. Referring to FIGS. 1A-G, exemplary strategies for RNAi are illustrated. Embodiments herein include RNAi constructs, methods and transgenic plants implementing an RNAi strategy. Promoters 101, 102, 103, 104, 105, 106, 107 and 108 may allow transcription of nucleic acid in the constructs. The strategy shown in FIG. 1E includes an XVE responsive promoter 109, and the strategy in FIG. 1D includes promoter fragments 110 and 111. Terminators 120, 121, 122, 123, 124, 125, 126, 127, 128, 129 and 130 are also illustrated, as are transcribed terminator sequences 122a and 123. Spacers 132, 133 and 134 are illustrated for strategies in FIGS. 1A, 1C and 1D, and the transcribed spacers 132a and 133b are illustrated for FIGS. 1A and 1C. Introns 140, 141 and 142 and transcribed intron 140a are illustrated in FIGS. 1B, 1E and 1F. cDNA fragments 150, 151, 152, 153, 154, 155, 156, 157, 158, 159, 160 and 161 are shown, as well as transcribed cDNA 150a, 151a, 152a, 153a, 154a, and ds RNA strand 154a'. In FIGS. 1E and 1F, loxP sites 170, 171 and 172 are illustrated. Embodiments include methods utilizing driver RNAs separated by an intron spacer as illustrated in FIG. 1B, and RNAi constructs, vectors, intermediate vectors, transformation vectors, primers, and transgenic plants for implementing the strategy of FIG. 1B. But embodiments herein are not limited to the strategy illustrated in FIG. 1B.

In an embodiment, isolated nucleic acids are provided having a sequence as set forth in any one of the nucleic acids listed herein or the complement thereof. In an embodiment, isolated nucleic acids having a sequence that hybridizes to a nucleic acid having the sequence of any nucleic acid listed herein or the complement thereof are provided. In an embodiment, the hybridization conditions are low stringency conditions. In an embodiment, the hybridization conditions are moderate stringency conditions. In an embodiment, the hybridization conditions are high stringency conditions. Examples of hybridization protocols and methods for optimization of hybridization protocols are described in the following books: Molecular Cloning, T. Maniatis, E. F. Fritsch, and J. Sambrook, Cold Spring Harbor Laboratory, 1982; and, Current Protocols in Molecular Biology, F. M. Ausubel, R. Brent, R. E. Kingston, D. D. Moore, J. G. Seidman, J. A. Smith, K. Struhl, Volume 1, John Wiley & Sons, 2000, which are incorporated by reference in their entirety as if fully set forth. Moderate conditions may be as follows: filters loaded with DNA samples are pretreated for 2-4 hours at 68° C. in a solution containing 6× citrate buffered saline (SSC; Amresco, Inc., Solon, Ohio), 0.5% sodium dodecyl sulfate (SDS; Amresco, Inc., Solon, Ohio), 5×Denhardt's solution (Amresco, Inc., Solon, Ohio), and denatured salmon sperm (Invitrogen Life Technologies, Inc. Carlsbad, Calif.). Hybridization is carried in the same solution with the following modifications: 0.01 M EDTA (Amresco, Inc., Solon, Ohio), 100 μg/ml salmon sperm DNA, and 5-20×10$^6$ cpm $^{32}$P-labeled or fluorescently labeled probes. Filters are incubated in hybridization mixture for 16-20 hours and then washed for 15 minutes in a solution containing 2×SSC and 0.1% SDS. The wash solution is replaced for a second wash with a solution containing 0.1×SSC and 0.5% SDS and incubated an additional 2 hours at 20° C. to 29° C. below Tm (melting temperature in ° C.). Tm=81.5+16.61 $\mathrm{Log}_{10}$([Na+]/(1.0+0.7[Na+]))+0.41(%[G+C])-(500/n)-P-F. [Na+]=Molar concentration of sodium ions. %[G+C]=percent of G+C bases in DNA sequence. N=length of DNA sequence in bases. P=a temperature correction for % mismatched base pairs (−1° C. per 1% mismatch). F=correction for formamide concentration (=0.63° C. per 1% formamide). Filters are exposed for development in an imager or by autoradiography. Low stringency conditions refers to hybridization conditions at low temperatures, for example, between 37° C. and 60° C., and the second wash with higher [Na+] (up to 0.825M) and at a temperature 40° C. to 48° C. below Tm. High stringency refers to hybridization conditions at high temperatures, for example, over 68° C., and the second wash with [Na+]= 0.0165 to 0.0330M at a temperature 5° C. to 10° C. below Tm.

In an embodiment, isolated nucleic acids having a sequence that has at least 75, 80, 85, 90, 91, 92, 93, 94, 95, 96, 97, 98, 99 or 100% identity along its length to a contiguous portion of a nucleic acid having any one of the sequences set forth herein or the complements thereof are provided. The contiguous portion may be the entire length of a sequence set forth herein or the complement thereof.

Determining percent identity of two amino acid sequences or two nucleic acid sequences may include aligning and comparing the amino acid residues or nucleotides at corresponding positions in the two sequences. If all positions in two sequences are occupied by identical amino acid residues or nucleotides then the sequences are said to be 100% identical. Percent identity may be measured by the Smith Waterman algorithm (Smith T F, Waterman M S 1981 "Identification of Common Molecular Subsequences," J Mol Biol 147: 195-197, which is incorporated herein by reference as if fully set forth).

In an embodiment, isolated nucleic acids, polynucleotides, or oligonucleotides are provided having a portion of the sequence as set forth in any one of the nucleic acids listed herein or the complement thereof. These isolated nucleic acids, polynucleotides, or oligonucleotides are not limited to but may have a length in the range from 10 to full length, 10 to 3000, 10 to 2900, 10 to 2800, 10 to 2700, 10 to 2600, to 2500, 10 to 2400, 10 to 2300, 10 to 2200, 10 to 2100, 10 to 2000, 10 to 1900, 10 to 1800, 10 to 1700, 10 to 1600, 10 to 1500, 10 to 1400, 10 to 1300, 10 to 1200, 10 to 1100, to 1000, 10 to 900, 10 to 800, 10 to 10 to 600, 10 to 500, 10 to 400, 10 to 300, 10 to 200, 10 to 100, 10 to 90, 10 to 80, 10 to 70, 10 to 60, 10 to 50, 10 to 40, 10 to 35, 10 to 30, 10 to 25, 10 to 20, 10 to 15, or 20 to 30 nucleotides or 10, 15, 20 or 25 nucleotides. An isolated nucleic acid, polynucleotide, or oligonucleotide having a length within one of the above ranges may have any specific length within the range recited, endpoints inclusive. The recited length of nucleotides may start at any single position within a reference sequence (i.e., any one of the nucleic acids herein) where enough nucleotides follow the single position to accommodate the recited length. In an embodiment, a hybridization probe or primer is 85 to 100%, 90 to 100%, 91 to 100%, 92 to 100%, 93 to 100%, 94 to 100%, 95 to 100%, 96 to 100%, 97 to 100%, 98 to 100%, 99 to 100%, or 100% complementary to a nucleic acid with the same length as the probe or primer and having a sequence chosen from a length of nucleotides corresponding to the probe or primer length within a portion of a sequence as set forth in any one of the nucleic acids listed herein. In an embodiment, a hybridization probe or primer hybridizes along its length to a corresponding length of a nucleic acid having the sequence as set forth in any one of the nucleic acids listed herein. In an embodiment, the hybridization conditions are low stringency. In an embodiment, the hybridization conditions are moderate stringency. In an embodiment, the hybridization conditions are high stringency.

Any of the isolated nucleic acids herein may be provided in a kit. The kit may be used to make an RNAi construct, produce transgenic plants, test a plant for the presence of a gene of interest, test a plant for the presence of an RNAi construct as described herein, or any other method or purpose described herein. A kit may include one or more vector herein or one or more probe or primer herein.

In an embodiment, a genetically engineered plant is provided. The genetically engineered plant may be derived from any plant. The genetically engineered plant may be derived from an energy crop plant, a forage crop plant or a food crop plant. The energy crop plant may be but is not limited to a corn plant, a switchgrass plant, a poplar plant or a miscanthus plant. The forage crop plant may be but is not limited to a sorghum plant. The food crop plant may be but is not limited to a corn plant or a tomato plant. The genetically engineered plant may be a transgenic plant. The transgenic plant may include an RNAi construct. The transgenic plant may include a genetic construct that inactivates or inhibits expression of at least one gene encoding a protein envolved in mobilization of starch in a plant. The transgenic plant may also include a nucleic acid encoding a polysaccharide degrading enzyme. The plant may be a rice plant, a switchgrass plant, a sorghum plant, a corn plant or a tomato plant.

A genetically engineered plant refers to a transgenic plant or a mutant plant, progeny of a transgenic plant or a genetically engineered plant, a descendant of a transgenic plant or a genetically engineered plant, or a part of any of the foregoing. A transgenic plant may include a genetic construct. The genetic construct may include a first nucleic acid that encodes a product that may inactivate or inhibit the expression of at least one gene encoding a protein involved in mobilization of starch in a plant. The genetic construct may also include a second isolated nucleic acid that encodes at least one polysaccharide degrading enzyme, which does not occur naturally in the plant. Upon the expression of the first nucleic acid and the second nucleic acid, the genetically engineered plant may have an altered level of vegetative starch compared to the level of vegetative starch in a non-genetically engineered plant of the same genetic background as the genetically engineered plant but lacking the genetic construct. The genetically engineered plant may express at least one polysaccharide degrading enzyme. The genetically engineered plant may include more than one genetic construct. The genetically engineered plant may include a first construct comprising a first isolated nucleic acid that encodes a product that may inactivate or inhibit the expression of at least one gene encoding a protein involved in mobilization of starch in a plant. The genetically engineered plant may also include a second genetic construct comprising a second nucleic acid that encodes at least one polysaccharide degrading enzyme. The genetic construct(s) may be integrated into a genome of the plant. The genetic construct(s) may be transiently expressed in the plant. As used herein, genetic background is defined as a plurality of all genes in a plant. Thus, plants of the same species or variety may be referred to as plants having the same genes or the same genetic background. A genetically engineered plant may include the genetic construct or constructs described herein and, otherwise, may have the same genes as non-genetically engineered plant of the same genetic background.

An embodiment includes a genetically engineered plant. The genetically engineered plant may be any one described herein. The genetically engineered plant may be a transgenic plant having an altered level of vegetative starch, or any part of the transgenic plant. The genetically engineered plant may be a transgenic plant expressing a polysaccharide degrading enzyme, or any part of the transgenic plant. The genetically engineered plant may be any transgenic plant having an altered level of vegetative starch and/or expressing a polysaccharide degrading enzyme, or any part of the transgenic plant. The genetically engineered plant may include a first isolated nucleic acid that encodes a product that inactivates or inhibits expression of at least one gene encoding a protein involved in mobilization of starch in a plant, and a second isolated nucleic acid that encodes at least one polysaccharide degrading enzyme. The first isolated nucleic acid may be as described below. The second isolated nucleic acid may be as described below. Upon the expression of the first nucleic acid, the genetically engineered plant may have an altered level of vegetative starch compared to the level of vegetative starch in a non-genetically engineered plant having the same genetic background as the genetically engineered plant but lacking the first isolated nucleic acid. The altered level may be an increased level.

A genetically engineered plant may be a conventional mutant having one or more mutations in a nucleic acid sequence of a gene resulted in inhibiting expression of the gene encoding an enzyme involved in mobilization of starch in a plant. The mutations may be deletions, insertions or substitutions of nucleic acids in a sequence of target genes. The conventional mutant may have an altered level of vegetative starch compared to a non-mutant plant of the same genetic background. The conventional mutant may be further genetically engineered to include a nucleic acid encoding a polysaccharide degrading enzyme. The conventional mutant having an altered level of vegetative starch may be also a transgenic plant expressing a polysaccharide degrading enzyme.

The genetically engineered plant may be of any type of plant. The genetically engineered plant may be but is not limited to corn, soybean, rice, sugar cane, sugar beet, sorghum, switchgrass, miscanthus, eucalyptus, willow, or poplar. A genetically engineered plant may be a whole transgenic plant or a mutant plant or parts of the plant. The parts may be but are not limited to leaves, stems, flowers, buds, petals, ovaries, fruits, or seeds. A genetically engineered plant may be callus from a transgenic plant or a mutant plant. A genetically engineered plant may be regenerated from parts of a transgenic plant or a mutant plant or plants. A genetically engineered plant may be a product of sexual crossing of a first transgenic plant and a second transgenic plant or a non-transgenic plant where the product plant retains a polynucleotide sequence introduced to the first transgenic plant. A genetically engineered plant may be a product of sexual crossing of a first mutant plant and a second non-mutant plant where the product plant retains a mutation introduced to the first mutant plant. The transgenic plant or the mutant plant may be any one of the transgenic plants or mutant plants provided herein.

An embodiment provides a genetic construct designed to implement a strategy for modifying levels of vegetative starch in plants. The genetic construct may include a first isolated nucleic acid that encodes a product that inactivates or inhibits expression of one or more genes encoding a protein involved in mobilization of starch in a plant. The product may be but is not limited to an RNAi construct, an hpRNA, an miRNA, a restricting enzyme, or a meganuclease. The protein may be but is not limited to Glucan Water Dikinase (GWD), Phosphoglucan Water Dikinase (PWD), Dual Specificity Protein Phosphatase (DSP), limit dextrinase (LDA), a disproportionating enzyme, a debranching enzyme, β-amylase (BAM) and isoamylase. The genetic construct may include a second isolated nucleic acid that encodes one or more polysaccharide degrading enzymes.

The genetic construct may further include an inverted complement of the first isolated nucleic acid, and a spacer contiguous with and between the first isolated nucleic acid and the inverted complement. The term "inverted complement" refers to a sequence complimentary to another sequence on the same strand of a nucleic acid. For example, an inverted complement of the first isolated nucleic acid is on the same strand as the first isolated nucleic acid. As a further example, an inverted complement of a nucleic acid sequence of OsDSP1:
TATGGTTGACAAGCTTGTGCAGTTTGCTAATCACA-GCAGGAAGCCTCAATCGCAAATCAAAAGCAT-CAAAATCCCTAATTTCGGCACGAC AGTGCTC-TATATCTTTACATTGTAGACAATATTCTTG-AATGGCACAGATGTCAACTCCAAAATAT-TCAAGGTCTGGATCTTGCTGCAGGC AGAATACT-GTTTTTACACCAATGTCCCTAAGTTTAT-CAACATCAAGTGGGCTCTGTAAGCAGGAGCCCAC-GATCAAGTCTGGGCGTATGA AATTGTAGTTCATTC-CAAGCTCATGTCTATACGTCA-ACACTGCTCCCATAGCTTGCGTCATGTTGGTGCTG-TACGTATCGGATTTCTCCG TGCCCGCCTCCACT-GCGCCACTCTGGGCGCTAGA-AGTAGACGCCCCGGATGCGGTTTTGACAGTGTTT-GATCGGCGACTCCCGCCACGAA CCATCGTCAGATT-GAGCGGCGAGGGCCGCCTCAT-GGACCTGGATCCCACGATTGGAGGCTCCTT-GAGCAGGTTCTGGAGGCAGTTCAT
(SEQ ID NO: 40) is the following sequence:

(SEQ ID NO: 172)
ATGAACTGCCTCCAGAACCTGCTCAAGGAGCCTCCAATCGTGGGATCCAG

GTCCATGAGGCGGCCCTCGCCGCTCAATCTGACGATGGTTCGTGGCGGGA

-continued
GTCGCCGATCAAACACTGTCAAAACCGCATCCGGGGCGTCTACTTCTAGC

GCCCAGAGTGGCGCAGTGGAGGCGGGCACGGAGAAATCCGATACGTACAG

CACCAACATGACGCAAGCTATGGGAGCAGTGTTGACGTATAGACATGAGC

TTGGAATGAACTACAATTTCATACGCCCAGACTTGATCGTGGGCTCCTGC

TTACAGAGCCCACTTGATGTTGATAAACTTAGGGACATTGGTGTAAAAAC

AGTATTCTGCCTGCAGCAAGATCCAGACCTTGAATATTTTGGAGTTGACA

TCTGTGCCATTCAAGAATATTGTCTACAATGTAAAGATATAGAGCACTGT

CGTGCCGAAATTAGGGATTTTGATGCTTTTGATTTGCGATTGAGGCTTCC

TGCTGTGATTAGCAAACTGCACAAGCTTGTCAACCATA.

A sequence of the inverted complement may be capable of hybridizing to a sequence of the first isolated nucleic acid. The sequence of the inverted complement may be capable of hybridizing to the sequence of the first isolated nucleic acid under in situ conditions in a genetically engineered plant. The sequence of the inverted complement may be capable of hybridizing to the sequence of the first nucleic acid sequence under conditions of one of low, moderate, or high stringency.

The genetic construct may also include a spacer contiguous with and between the first isolated nucleic acid and the inverted complement. The spacer may be operably linked to the first isolated nucleic acid and the inverted complement and may provide a connection between the first isolated nucleic acid and the inverted complement such that the RNA sequences transcribed from the first isolated nucleic acid and the inverted complement can hybridize with one another. The first isolated nucleic acid may be upstream from and contiguous with the spacer, and the spacer may be upstream from and contiguous with the inverted complement. The inverted complement may be upstream from and contiguous with the spacer, and the spacer may be upstream from and contiguous with the first nucleic acid. An operably linked spacer may be an intron. The intron may splice the sequences of the first isolated nucleic and the inverted complement.

The genetic construct may include a promoter operably linked to the first isolated nucleic acid, the inverted complement and the spacer. The operably linked promoter may allow transcription of the first isolated nucleic acid, the inverted complement and the spacer. Transcription of the first isolated nucleic acid, the inverted complement and the spacer may be referred to as expression of the first isolated nucleic acid, the inverted complement and the spacer. Upon expression of the first isolated nucleic acid, the inverted complement and the spacer, the RNA sequence transcribed from the first isolated nucleic acid and the RNA sequence transcribed from the inverted complement may be capable of hybridizing with each other. The hybridized RNA transcripts of the first isolated nucleic acid and the inverted complement may be capable of inhibiting expression of the gene. A transgenic plant may include more than one kind of RNAi construct. Each different kind of RNAi construct may be directed to inhibiting a different gene expressing a different target protein. The target gene may be selected from one or more gene encoding a protein involved in mobilization of starch in a plant. The protein may be but is not limited to Glucan Water Dikinase (GWD), Phosphoglucan Water Dikinase (PWD), Dual Specificity Protein Phosphatase (DSP), limit dextrinase (LDA), a disproportionating enzyme, a debranching enzyme, β-amylase (BAM), or isoamylase.

In an embodiment, a first isolated nucleic acid and an inverted repeat may encode a product that may be an hpRNA. The hpRNA may be homologous to a portion of a messenger RNA encoding a protein involved in mobilization of starch in a plant. The hpRNA may be homologous to a portion of a messenger RNA encoding the 5' UTR, or the 3' UTR sequences for a protein involved in mobilization of starch in a plant. The sequences that are complementary to a messenger RNA are called "driver sequences."

In an embodiment, a first isolated nucleic acid may encode a product that may be an RNAi construct. The RNAi construct may be designed to implement any RNAi strategy, including but not limited to those illustrated in FIG. 1A-G. An RNAi construct may include a first isolated nucleic acid having a sequence complementary to a portion of a gene in the genetically engineered plant encoding a target protein involved in mobilization of vegetative starch. The first isolated nucleic acid may be a first driver sequence. The first isolated nucleic acid may have at least 75, 80, 85, 90, 91, 92, 93, 94, 95, 96, 97, 98, 99 or 100% identity along the length of the isolated nucleic acid to a portion of a gene in the genetically engineered plant encoding a target protein involved in mobilization of vegetative starch. The length of the first nucleic acid may be any suitable length to provide an RNAi affect. The RNAi construct may include an inverted complement of the first isolated nucleic acid. The inverted complement may be a second driver sequence.

The first isolated nucleic acid may include a portion having at least 75, 80, 85, 90, 91, 92, 93, 94, 95, 96, 97, 98, 99, or 100% identity to a sequence of the target gene. Identity may be measured along the entire length of the sequence of the target gene. The target gene may be selected from the one or more gene encoding a protein involved in mobilization of vegetative starch in a plant. The target gene may be any gene involved in mobilization of vegetative starch in a plant. There may be more than one target gene. The length of the portion of the first isolated nucleic acid may be equal to the length of the target gene. The length of the portion may be but is not limited to being 15, 20, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 205, 210, 215, 220, 225, 230, 235, 240, 245, 250, 255, 260, 265, 270, 275, 280, 285, 290, 295, 300, 305, 310, 315, 320, 325, 330, 335, 340, 345, 350, 355, 360, 365, 370, 375, 380, 385, 390, 395, 400, 405, 410, 415, 420, 425, 430, 435, 440, 445, 450, 455, 460, 465, 470, 475, 480, 485, 490, 495, 500, 505, 510, 515, 520, 525, 530, 535, 540, 545, 550, 555, 560, 565, 570, 575, 580, 585, 590, 595, 600, 605, 610, 615, 620, 625, 630, 635, 640, 645, 650, 655, 660, 665, 670, 675, 680, 685, 690, 695, or 700 nucleotides in length, or any length within a range between any two of the foregoing lengths.

In an embodiment, a first isolated nucleic acid may encode the product that may be an miRNA capable of targeting a messenger RNA transcribed from the target gene. The first isolated nucleic acid may be 18 to 25 nucleotides in length. The first isolated nucleic acid may be 10, 15, 20, 25, 30, 35, 40, 45, 50, 55, 60, 65, 70, 75, 80, 85, 90, 95, 100, 105, 110, 115, 120, 125, 130, 135, 140, 145, 150, 155, 160, 165, 170, 175, 180, 185, 190, 195, 200, 205, 210, 215, 220, 225, 230, 235, 240, 245, 250, 255, 260, 265, 270, 275, 280, 285, 290, 295, or 300 nucleotides in length, or any length within a range between any two of the foregoing lengths.

In an embodiment, a first isolated nucleic acid may encode a product that may be a restricting enzyme capable of cutting a sequence of the target gene. The restricting enzyme may be but is not limited to a meganuclease, a zinc-finger nuclease, or a TAL effector nuclease. The meganuclease may be I-CreI, I-DmoI, I-SceI, E-DmeI or Dmo-Cre. Other known meganucleases may be used.

The genetic construct may include a first isolated nucleic acid encoding a product that has any suitable sequence to affect expression of a gene coding for a target protein. The sequence may be suitable to affect RNAi of a gene coding for a target protein. The first isolated nucleic acid may include a sequence with at least 75, 80, 85, 90, 91, 92, 93, 94, 95, 96, 97, 98, 99, or 100% identity to a reference sequence selected from the group consisting of: SEQ ID NO: 38 [OsGWD amiRNA1wmd3], SEQ ID NO: 39 [OsGWD osa-MR809aM1 micro RNA], SEQ ID NO: 40 [OsDSP1], SEQ ID NO: 41 [OsDSP2], SEQ ID NO: 42 [OsGWD1], SEQ ID NO: 43 [OsGWD2], SEQ ID NO: 44[OsPWD1], SEQ ID NO: 45 [OsPWD2], SEQ ID NO: 46[SbGWD-SbGWDko2b-flanking seqs], SEQ ID NO: 47 [SbGWD1], SEQ ID NO: 48 [SbGWD2], SEQ ID NO: 49 [ZmGWD1], SEQ ID NO: 50 [ZmGWD2], SEQ ID NO: 179 [GWD1], SEQ ID NO: 180 [GWD2], SEQ ID NO: 183 [DSP1], SEQ ID NO: 184 [ISA3], SEQ ID NO: 209 [PvGWDko2], and SEQ ID NO: 216 [SbGWDko2a-flanking seqs]. Identity may be measured along the entire length of the reference sequence. The length of the first isolated nucleic acid may be equal to the length of the reference sequence.

The RNAi construct may include a first isolated nucleic acid capable of hybridizing to a nucleic acid comprising, consisting essentially of or consisting of a reference sequence selected from the group consisting of: SEQ ID NO: 38 [OsGWD amiRNA1wmd3], SEQ ID NO: 39 [OsGWD osa-MR809aM1 micro RNA], SEQ ID NO: 40 [OsDSP1], SEQ ID NO: 41 [OsDSP2], SEQ ID NO: 42 [OsGWD1], SEQ ID NO: 43 [OsGWD2], SEQ ID NO: 44[OsPWD1], SEQ ID NO: 45 [OsPWD2], SEQ ID NO: 46[SbGWD-SbGWDko2b-flanking seqs], SEQ ID NO: 47 [SbGWD1], SEQ ID NO: 48 [SbGWD2], SEQ ID NO: 49 [ZmGWD1], SEQ ID NO: 50 [ZmGWD2], SEQ ID NO: 179 [GWD1], SEQ ID NO: 180 [GWD2], SEQ ID NO: 183 [DSP1], SEQ ID NO: 184 [ISA3], SEQ ID NO: 209 [PvGWDko2], and SEQ ID NO: 216 [SbGWDko2a-flanking seqs], or the complement thereof under conditions of one of low, moderate or high stringency.

The RNAi construct may include the sequence of an inverted complement capable of hybridizing with the sequence of the first isolated nucleic acid under in situ conditions in the genetically engineered plant. The RNAi construct may include the sequence of the inverted complement capable of hybridizing with the sequence of the first isolated nucleic acid under conditions of one of low, moderate or high stringency.

The RNAi construct may include an inverted complement having at least 75, 80, 85, 90, 91, 92, 93, 94, 95, 96, 97, 98, 99 or 100% identity to the inverted complement of a reference sequence selected from the group consisting of: SEQ ID NO: 40 [OsDSP1], SEQ ID NO: 41 [OsDSP2], SEQ ID NO: 42 [OsGWD1], SEQ ID NO: 43 [OsGWD2], SEQ ID NO: 44[OsPWD1], SEQ ID NO: 45 [OsPWD2], SEQ ID NO: 46[SbGWD-SbGWDko2b-flanking seqs], SEQ ID NO: 47 [SbGWD1], SEQ ID NO: 48 [SbGWD2], SEQ ID NO: 49 [ZmGWD1], SEQ ID NO: 50 [ZmGWD2], SEQ ID NO: 179 [GWD1], SEQ ID NO: 180 [GWD2], SEQ ID NO: 183 [DSP1], SEQ ID NO: 184 [ISA3], SEQ ID NO: 209 [PvGWDko2], and SEQ ID NO: 216 [SbGWDko2a-flanking seqs]. Identity may be measured along the length of the inverted complement of the reference sequence. The length of the inverted complement may be equal to the length of the inverted complement of the reference sequence.

The spacer may be any sequence. The spacer may be an intron. The intron may be any intron. The intron may be the OsUbi intron. The sequence of the OsUbi intron may be found in the sequence of pAL409 having SEQ ID NO: 185 with reference to FIG. 2 which illustrates pAL409 with the OsUbi intron between positions 4519-566. Nucleotide numbering in SEQ ID NO: 185 may vary from that labeled in FIG. 2 but comparison of landmark sequences (e.g., restriction sites) between FIG. 2 and SEQ ID NO: 185 allows identification of any specific sequence of a pAL409 feature. The sequence the OsUbi intron within the sequence of SEQ ID NO: 185 may be identified based on the restriction sites for restriction enzymes BspE1 and AgeI. The sequence of the OsUbi intron may be located within the sequence of SEQ ID NO: 185 between the sequences CCTAGG, the restriction site for BspE1, and ACCGGT, the restriction site for AgeI. The intron may have a sequence that has at least 75, 80, 85, 90, 91, 92, 93, 94, 95, 96, 97, 98, 99 or 100% identity to the OsUbi intron. The intron may have a sequence having at least 75, 80, 85, 90, 91, 92, 93, 94, 95, 96, 97, 98, 99, or 100 identity to a reference sequence selected from the group consisting of: SEQ ID NO: 51 [ZmAdh1i6], SEQ ID NO; 52 [OsAdh1i], SEQ ID NO: 53 [SbAdh1-2i], and SEQ ID NO: 54[SbGWDi]. The intron may have a sequence that hybridizes to the OsUbi intron, or a complement thereof under conditions of one of low, moderate, or high stringency. The intron may have a sequence that hybridizes to a reference sequence selected from the group consisting of SEQ ID NO: 51 [ZmAdh1i6], SEQ ID NO; 52 [OsAdh1i], SEQ ID NO: 53 [SbAdh1-2i], and SEQ ID NO: 54[SbGWDi], or the complement thereof under conditions of one of low, moderate or high stringency.

A protein involved in mobilization of starch in a plant may be a target protein. The target protein may be any protein involved with regulation of Green Starch. For example, the target protein may be one of Glucan Water Dikinase, Phosphoglucan Water Dikinase, Dual Specificity Protein Phosphatase, β-amylase, isoamylase, limit dextrinase, disproportionating enzyme, or a debranching enzyme. The target gene may encode the target protein. The target gene may be selected from the one or more genes encoding a protein involved in mobilization of starch in a plant. The target gene encoding the target protein may have a sequence with at least 75, 80, 85, 90, 91, 92, 93, 94, 95, 96, 97, 98, 99, or 100% identity to a reference sequence selected from the group consisting of: SEQ ID NO: 5 [SbGWD coding seq], SEQ ID NO: 6 [ZmGWD coding seq], SEQ ID NO: 7 [OsGWD coding sequence], SEQ ID NO: 8 [SbGWD gene], SEQ ID NO: 9 [ZMGWD gene], SEQ ID NO: 10 [SbGWD gene 5'UTR and promoter], SEQ ID 11 [ZmGWD gene 5'UTR and promoter], SEQ ID NO: 12 [SbGWD gene 3'UTR], SEQ ID NO: 13 [ZmGWD gene 3'UTR], SEQ ID NO: 17 [SbPWD coding seq], SEQ ID NO: 18 [ZmPWD coding seq], SEQ ID NO: 19 [OsPWD coding seq], SEQ ID NO: 20 [SbPWD gene], SEQ ID NO: 21 [ZmPWD gene]. SEQ ID NO: 22 [SbPWD gene 5'UTR and promoter], SEQ ID NO: 23 [SbPWD gene 3'UTR], SEQ ID NO: 24 [ZmPWD gene 3'UTR], SEQ ID NO: 29 [ZmDSP coding sequence], SEQ ID NO: 30 [SbDSP coding sequence], SEQ ID NO: 31 [OsDSP coding sequence], SEQ ID NO: 32 [ZmDSP gene], SEQ ID NO: 33 [SbDSP gene], SEQ ID NO: 34 [ZmDSP gene 5'UTR and promoter], SEQ ID NO: 35 [SbDSP gene 5'UTR and promoter], SEQ ID NO: 36 [ZmDSP 3'UTR], SEQ ID NO: 37 [SbDSP gene 3'UTR], SEQ ID NO: 173 [OsGWD gene], SEQ ID NO: 174 [DSP gene], SEQ ID NO: 175 [ISA3 gene], SEQ ID NO: 176 [OsGWD coding sequence], SEQ ID NO: 177 [DSP coding sequence], SEQ ID NO: 178 [ISA3 coding sequence], SEQ ID NO: 182 [portion of SlGWD gene], SEQ ID NO: 191 [SbGWD gene-1], SEQ ID NO: 192 [SbGDW gene-2], SEQ ID NO: 206 [PvGWD-2], SEQ ID NO: 207 [PvGWD-5], SEQ ID NO: 208 [PvGWD-1], and SEQ ID NO: 215 [switchgrass amalgamated sequence]. Identity may be measured along the entire length of the reference sequence. The length of the sequence of the target gene may be equal to the length of the reference sequence.

The target gene encoding the target protein may have a sequence that hybridizes to a reference sequence selected from the group consisting of: SEQ ID NO: 5 [SbGWD coding seq], SEQ ID NO: 6 [ZmGWD coding se], SEQ ID NO: 7 [OsGWD coding sequence], SEQ ID NO: 8 [SbGWD gene], SEQ ID NO: 9 [ZMGWD gene], SEQ ID NO: 10 [SbGWD gene 5'UTR and promoter], SEQ ID 11 [ZmGWD gene 5'UTR and promoter], SEQ ID NO: 12 [SbGWD gene 3'UTR], SEQ ID NO: 13 [ZmGWD gene 3'UTR], SEQ ID NO: 17 [SbPWD coding seq], SEQ ID NO: 18 [ZmPWD coding seq], SEQ ID NO: 19 [OsPWD coding seq], SEQ ID NO: 20 [SbPWD gene], SEQ ID NO: 21 [ZmPWD gene]. SEQ ID NO: 22 [SbPWD gene 5'UTR and promoter], SEQ ID NO: 23 [SbPWD gene 3'UTR], SEQ ID NO: 24 [ZmPWD gene 3'UTR], SEQ ID NO: 29 [ZmDSP coding sequence], SEQ ID NO: 30 [SbDSP coding sequence], SEQ ID NO: 31 [OsDSP coding sequence], SEQ ID NO: 32 [ZmDSP gene], SEQ ID NO: 33 [SbDSP gene], SEQ ID NO: 34 [ZmDSP gene 5'UTR and promoter], SEQ ID NO: 35 [SbDSP gene 5'UTR and promoter], SEQ ID NO: 36 [ZmDSP 3'UTR], SEQ ID NO: 37 [SbDSP gene 3'UTR], SEQ ID NO: 173 [OsGWD gene], SEQ ID NO: 174 [DSP gene], SEQ ID NO: 175 [ISA3 gene], SEQ ID NO: 176 [OsGWD coding sequence], SEQ ID NO: 177 [DSP coding sequence], SEQ ID NO: 178 [ISA3 coding sequence], SEQ ID NO: 182 [portion of SlGWD gene], SEQ ID NO: 191 [SbGWD gene-1], SEQ ID NO: 192 [SbGDW gene-2], SEQ ID NO: 206 [PvGWD-2], SEQ ID NO: 207 [PvGWD-5], SEQ ID NO: 208 [PvGWD-1], and SEQ ID NO: 215 [switchgrass amalgamated sequence], or the complement thereof under conditions of one of low, moderate or high stringency.

In an embodiment, the genetic construct may include the first isolated nucleic acid that encodes a product that inactivates or inhibits expression of one or more genes encoding a protein involved in mobilization of starch in a plant, and the second isolated nucleic acid that encodes one or more polysaccharide degrading enzymes. A transgenic plant may include more than one kind of genetic construct. Each different kind of genetic construct may be directed to inhibiting a different gene expressing a different target protein and expressing a different polysaccharide degrading enzyme. One genetic construct may include the first isolated nucleic acid. Another genetic construct may include the second isolated nucleic acid. The target gene may be selected from one or more gene encoding a protein involved in mobilization of starch in a plant. The at least one polysaccharide degrading enzyme may be but is not limited to a xylanase, an endoglucanase, an exoglucanase, an amylase, an intein-modified xylanase, an intein-modified endoglucanase, an intein-modified exoglucanase, and an intein-modified amylase.

In an embodiment, the second nucleic acid may have at least 75, 80, 85, 90, 91, 92, 93, 94, 95, 96, 97, 98, 99, or 100% identity to a reference sequence selected from the group consisting of: SEQ ID NO: 86 [O43097], SEQ ID NO:

87 [BD22308], SEQ ID NO: 88 [BD25243], SEQ ID NO: 89 [EU591743], SEQ ID NO: 90 [NtEGm], SEQ ID NO: 91 [P0C2S1], SEQ ID NO: 92 [P77853], SEQ ID NO: 93 [O68438], SEQ ID NO: 94 [O33897], SEQ ID NO:164 [amylase 19862], SEQ ID NO: 165 [glucoamylase 20082], SEQ ID NO: 166 [glucoamylase 20707], SEQ ID NO: 167 [amylase 21853], SEQ ID NO: 168 [AmyS], SEQ ID NO: 170 [GlaA], SEQ ID NO: 104 [EU591743:AS146-7], SEQ ID NO: 105 [P77853:S158-30-108-35], and SEQ ID NO: 106 [P77853:T134-101-100]. Identity may be measured along the entire length of the reference sequence. The length of the sequence of the second nucleic acid may be equal to the length of the reference sequence.

In an embodiment, the second isolated nucleic acid may encode a "variant" of a polysaccharide degrading enzyme. The amino acid sequence of a variant of a polysaccharide degrading enzyme may differ by deletions, additions, substitutions of amino acid sequences, or other modifications of the polysaccharide degrading enzyme. A variant of a polysaccharide degrading enzyme may maintain the biological activity of the polysaccharide degrading enzyme. To maintain biological activity as used herein means that the variant has at least 60% of the activity of the polysaccharide degrading enzyme from which it is derived Activity of a xylanase and an a endoglucanase may be assessed in an assay using Xylazyme AX substrate and Cellazyme substrate, respectively, as described in U.S. application Ser. No. 10/886,393 filed Jul. 7, 2004 and PCT/US10/55746 filed Nov. 5, 2010, and PCT/US10/55669 filed Nov. 5, 2010 and PCT/US10/55751 filed Nov. 5, 2010, which are incorporated herein by reference as if fully set forth. Activity of a exoglucanase may be assessed by using fluorescent 4-methylumbelliferyl-b-D-lactopyranoside (4-MU) as described in Harrison M D et al. 2011 "Accumulation of recombinant cellobiohydrolase and endoglucanase in the leaves of mature transgenic sugar cane," Plant Biotechnology Journal 9: 884-896 and incorporated here by reference as if fully set forth. Activity of a feruloyl esterase may be assessed using an assay using pNP labeled ferulate as a substrate (as described in Hegde S. et al. 2009 "Single-step synthesis of 4-nitrophenyl ferulate for spectrophotometric assay of feruloyl esterases," Analytical Biochemistry 387 (1): 128-129). The foregoing tests for activity of a xylanase, endoglucanase, exoglucanase, or feruloyl esterase may be utilized to determine whether a sequence with less than 100% identity to a polysaccharide degrading enzyme sequence herein is a variant of the polysaccharide degrading enzyme. Variants of a polysaccharide degrading enzyme herein may be modified in amino acid sequence versus the polysaccharide degrading enzyme based on similarity in hydrophobicity, hydrophilicity, solubility, polarity of amino acid residues. Variants of a polysaccharide degrading enzyme herein may differ following post-translational modifications. The differing post-translational modification may be but are not limited to glycosylations, acetylations, or phosphorylations. A variant may be developed by any means. A variant may be developed through site-directed mutagenesis or non-targeted mutagenesis. Error-prone PCR may be used to create mutants of a polysaccharide degrading enzyme herein, and any of the assays above may be used to assess whether the mutant is a variant.

Embodiments include at least one of the polysaccharide degrading enzymes, or variants thereof, fused to variants of at least one of a targeting peptide, or a carboxy targeting peptide. Variants of a targeting peptide or a carboxy targeting peptide will target the protein it is fused with to the same location as the reference sequence for the targeting peptide or carboxy targeting peptide.

Variants of an intein may be provided in a sequence of the polysaccharide degrading enzyme. An intein variant may splice from the protein in which it is fused.

In an embodiment, a genetic construct may include a sequence with at least 75, 80, 85, 90, 91, 92, 93, 94, 95, 96, 97, 98, 99, or 100% identity to a reference sequence selected from the group consisting of SEQ ID NO: 59 [OsUbi3P: OsGWD amiRNA1wmd3], SEQ ID NO: 60 [OsUbi3P: OsGWD osa-MIR809aM1], SEQ ID NO: 61 [OsUbi3P: OsDSP1 hpRNA], SEQ ID NO: 62 [OsUbi3P:OsDSP2 hpRNA], SEQ ID NO: 63 [OsUbi3P:OsGWD1 hpRNA], SEQ ID NO:64 [OsUbi3P:OsGWD2 hpRNA], SEQ ID NO: 65 [OsUbi3P: OsPWD1 hpRNA], SEQ ID NO: 66 [OsUbi3P:OsPWD2 hpRNA], SEQ ID NO: 67 [OsUbi3P: SbGWD RNAi], SEQ ID NO: 68 [ZmPepCP:SbGWD1 RNAi], SEQ ID NO: 69 [ZmPepCP:SbGWD2 RNAi], SEQ ID NO: 70 [ZmPepCP:ZmGWD1 RNAi], SEQ ID NO: 71 [ZmPepCP:ZmGWD2 RNAi], SEQ ID NO: 72 [OsDSP1 and OsGWD2], SEQ ID NO: 73 [OsPWD2 and OsGWD1], SEQ ID NO: 74 [OsDSP2 and OsPWD1], SEQ ID NO: 119 [ZmUbi1P:xGZein27ss:BD22308:xHvVSD], SEQ ID NO: 120 [ZmPepCP:xGZein27ss:BD25243:SEKDEL], SEQ ID NO: 121 [OsUbi3P:EU591743], SEQ ID NO: 122 [ZmUbi1P:EU591743: AS146-7:SEKDEL], SEQ ID NO: 123 [ZmUbilp:HvAle:NtEGm:SEKDEL], SEQ ID NO: 124 [ZmPepCP:HvAle:NtEGm:SEKDEL], SEQ ID NO: 125 [OsUbi3P:HvAle:NtEGm:SEKDEL], SEQ ID NO: 126 [OsUbi3P:BAASS: O33897], SEQ ID NO: 127 [ZmPepCP: BAASS:O43097:SEKDEL], SEQ ID NO: 128 [OsUbi3P: O68438], SEQ ID NO: 129 [OsUbi3P:P0C2S1], SEQ ID NO: 130 [ZmUbi1P:ZmUBQm:BAASS:P77853:S158-30-108-35], SEQ ID NO: 131 [ZmUbi1P:BAASS:P77853: T134-100-101:SEKDEL], SEQ ID NO: 132 [2379 cassette-3 CWDE and 1 hpRNA], SEQ ID NO: 133 [2380 cassette-3 CWDE and 1 hpRNA], SEQ ID NO: 134 [4106 cassette-3 CWDE and 1 hpRNA], SEQ ID NO: 135 [4107 cassette-3 CWDE and 1 hpRNA], SEQ ID NO: 136 [4108 cassette-3 CWDE and 1 hpRNA], SEQ ID NO: 137 [4109 cassette-3 CWDE and 1 hpRNA], SEQ ID NO: 138 [4110 cassette-3 CWDE and 1 hpRNA], SEQ ID NO:139 [4111 cassette-3 CWDE and 1 hpRNA], SEQ ID NO: 140 [4112 cassette-3 CWDE and 1 hpRNA], SEQ ID NO: 141 [4113 cassette-3 CWDE and 1 hpRNA], SEQ ID NO: 142 [4114 cassette 3 CWDE and 1 hpRNA], SEQ ID NO: 143 [4115 cassette-3 CWDE and 1 hpRNA], SEQ ID NO: 144 [4116 cassette-3 CWDE and 1 hpRNA], SEQ ID NO: 145 [4117 cassette-3 CWDE and 1 hpRNA], SEQ ID NO: 146 [4120 cassette-3 CWDE and 1 hpRNA], SEQ ID NO: 147 [4121 cassette-3 CWDE and 1 hpRNA], SEQ ID NO: 148 [4124 cassette-3 CWDE and 1 hpRNA], SEQ ID NO: 149 [4125 cassette-2 CWDE and 1 hpRNA], SEQ ID NO:150 [4514 cassette-2 CWDE and 1 hpRNA], and SEQ ID NO: 151 [4515 cassette-3 CWDE and 1 hpRNA]. Identity may be measured along the entire length of the reference sequence. The length of the sequence may be equal to the length of the reference sequence.

The genetic construct may further include a regulatory sequence (also referred to as a regulatory element) operably connected to a first isolated nucleic acid or a second isolated nucleic acid. In this context, operably connected means that the regulatory sequence imparts it function to the nucleic acid or the polynucleotide sequence. In the case of a regulatory sequence that is a promoter, the promoter is capable of controlling expression of the nucleic acid or the polynucleotide sequence when they are operably connected. The promoter may be operably linked to the first isolated nucleic acid. The promoter may be operably linked to the second isolated nucleic acid. The operably linked promoter may be any kind of promoter. The operably linked promoter may be an inducible promoter. The operably linked promoter may be a constitutive promoter. The promoter may be an inducible promoter, which initiates transcription of the polynucleotide sequences only when exposed to a particular chemical or environmental stimulus. Examples of inducible promoters include but are not limited to those that are an alcohol inducible promoter, a tetracycline inducible promoter, a steroid inducible promoter, or a hormone inducible promoter. The promoter may be a constitutive promoter. The promoter may be a constitutive promoter, which provides transcription of the nucleic acids or polynucleotide sequences throughout the plant in most cells, tissues and organs and during many but not necessarily all stages of development. The promoter may be specific to a particular developmental stage, organ, or tissue. A tissue specific promoter may be capable of initiating transcription in a particular plant tissue. Plant tissue that may be targeted by a tissue specific promoter may be but is not limited to a stem, leaves, trichomes, anthers, or seed. A constitutive promoter herein may be the rice Ubiquitin 3 promoter (OsUbi3P) or maize the phosphoenolpyruvate carboxylase promoter (ZmPepCP). Other known constitutive promoters may be used, and include but are not limited to Cauliflower Mosaic Virus (CAMV) 35S promoter, the Cestrum Yellow Leaf Curling Virus promoter (CMP) or the CMP short version (CMPS), the Rubisco small subunit promoter, the rice acting promoter (OsAct1P) and the maize ubiquitin promoter (ZmUbi1P). The tissue specific promoter may include the seed-specific promoter. The seed specific promoter may be but is not limited to the rice GluB4 promoter or the maize zein promoter. The promoter may be the P-OsUbi promoter. The sequence of the P-OsUbi promoter may be found in the sequence of pAL409 having SEQ ID NO: 185 with reference to FIG. 2, which illustrates pAL409 with the P-OsUbi promoter between positions 3574-4507. Nucleotide numbering in SEQ ID NO: 185 may vary from that labeled in FIG. 2 but comparison of landmark sequences (e.g., restriction sites) between FIG. 2 and SEQ ID NO: 185 allows identification of any specific sequence of a pAL409 feature. The sequence of the P-OsUbi promoter may be identified based on the restriction sites for restriction enzymes PacI and AvrII. The sequence of the P-OsUbi promoter may be located between sequences TTAATTAA, the restriction site for PacI, and CCTAGG, the restriction site for AvrII. The promoter may include a sequence with at least 75, 80, 85, 90, 91, 92, 93, 94, 95, 96, 97, 98, 99 or 100% identity to the P-OsUbi promoter. The promoter may include a sequence that hybridizes to the P-OsUbi promoter or the complement thereof under conditions of low stringency. The promoter may include a sequence that hybridizes to the P-OsUbi promoter or the complement thereof under conditions of moderate stringency. The promoter may include a sequence that hybridizes to the P-OsUbi promoter or the complement thereof under conditions of high stringency.

In the case of a regulatory element that is a terminator, the terminator is capable of terminating transcription of the nucleic acid or the polynucleotide sequence. A terminator sequence may be included at the 3' end of a transcriptional unit of the expression cassette. The terminator may be derived from a variety of plant genes. The terminator may be a terminator sequence from the nopaline synthase (NOS) or octopine synthase (OCS) genes of *Agrobacterium tumefaciens*. The terminator sequence may be the CaMV 35S terminator from CaMV, or any of the 3'UTR sequences shown to terminate the transgene transcription in plants. For example, the maize PepC terminator (3'UTR) can be used.

In an embodiment, a first isolated nucleic acid or the second isolated nucleic acid may further include a targeting polynucleotide sequence encoding a targeting peptide. A targeting peptide may be fused to one or more polysaccharide degrading enzymes. When a second isolated nucleic acid encodes more than one polysaccharide degrading enzyme, a targeting peptide may be independently selected for each of the polysaccharide degrading enzymes. A targeting peptide may be selected from but is not limited to an amyloplast targeting signal, a cell wall targeting peptide, a mitochondrial targeting peptide, a cytosol localization signal, a chloroplast targeting signal, a nuclear targeting peptide, and a vacuole targeting peptide. A targeting polynucleotide may be upstream of the first isolated nucleic acid or the second isolated nucleic acid. A targeting peptide may have at least 70, 72, 75, 80, 85, 90, 91, 92, 93, 94, 95, 96, 97, 98, 99, or 100% identity to one of BAASS (SEQ ID NO: 107), SEKDEL signal peptide (SEQ ID NO: 108), xHvVSD targeting signal (SEQ ID NO: 109), the ZmUBQm translational fusion (SEQ ID NO: 110), the xGZein27ss (SEQ ID NO: 111), or the HvAle signal (SEQ ID NO: 112).

In an embodiment, a genetic construct may be inserted in a vector appropriate for genetically engineering a plant. Vectors incorporating a genetic construct herein may also include additional genetic elements such as multiple cloning sites to facilitate molecular cloning and selection markers to facilitate selection. A selectable marker that may be included in a vector may be a phosphomannose isomerase (PMI) gene from *Escherichia coli*, which confers to the transformed cell the ability to utilize mannose for growth. Selectable markers that may be included in a vector include but are not limited to a neomycin phosphotransferase (npt) gene, conferring resistance to kanamycin, a hygromycin phosphotransferase (hpt) gene, conferring resistance to hygromycin, and an enolpyruvylshikimate-3-phosphate synthase gene, conferring resistance to glyphosate.

An embodiment includes a vector having any genetic construct herein. The vector may be an intermediate vector. The vector may be a transformation vector. The genetic construct in the vector may have a any isolated nucleic acid or polynucleotide described herein.

A vector herein may be configured for expression in a host having the gene targeted by the genetic construct. The genetic construct may be an RNAi construct. Upon expression, an RNA sequence transcribed from the first isolated nucleic acid and an RNA sequence transcribed from the inverted complement may be capable of hybridizing with each other and causing inhibition of expression of the gene in the host.

A vector herein may have a sequence comprising, consisting essentially of or consisting of a sequence having at least 75, 80, 85, 90, 91, 92, 93, 94, 95, 96, 97, 98, 99 or 100% identity to a reference sequence selected from the group consisting of SEQ ID NO: 187 [pAG2100], SEQ ID NO: 188 [pAG2101], SEQ ID NO: 189 [pAG2102], SEQ ID NO: 190 [pAG2103], SEQ ID NO: 195 [pAG2106] and SEQ ID NO: 218 [pAL409jSbGWDko2].

A vector herein may have a sequence comprising, consisting essentially of or consisting of a sequence having at least 75, 80, 85, 90, 91, 92, 93, 94, 95, 96, 97, 98, 99 or 100% identity to a reference sequence selected from the group consisting of SEQ ID NO: 185 [pAL409] and SEQ ID NO: 186 [pAG2004].

An embodiment provides a method of making a genetically engineered plant. A genetically engineered plant may be constructed by any method of genetic engineering. A genetically engineered plant may be a transgenic plant. A transgenic plant may be transformed by any known method of transformation. *Agrobacterium* mediated transformation may be utilized. The transgenic plant may be created by other methods for transforming a plant, for example, particle bombardment or direct DNA uptake. The plant may be any kind of plant. The plant may be an energy crop plant, a food crop plant or a forage crop plant. The plant may be a rice plant, a switchgrass plant, a sorghum plant, a corn plant or a tomato plant. The transformation may be done with any suitable vector including or consisting of any one or more genetic construct herein. The transgenic plant may be created by *Agrobacterium*-mediated transformation using a vector that includes a first nucleic acid encoding a product that inactivates or inhibits one or more gene encoding a protein involved in mobilization of starch in a plant, and a second isolated nucleic acid that encodes at least one polysaccharide degrading enzyme. *Agrobacterium* mediated transformation may utilize any suitable transformation vector harboring any one or more RNAi construct herein. *Agrobacterium* mediated transformation may be done with a vector having a sequence with at least 75, 80, 85, 90, 91, 92, 93, 94, 95, 96, 97, 98, 99 or 100% identity to a sequence selected from the group consisting of SEQ ID NO: 187 [pAG2100], SEQ ID NO: 188 [pAG2101], SEQ ID NO: 189 [pAG2102], SEQ ID NO: 190 [pAG2103], SEQ ID NO: 195 [pAG2106] and SEQ ID NO: 218 [pAL409jSbGWDko2]. The transgenic plant may include any isolated nucleic acid, amino acid sequence, genetic construct, or vector described herein.

The mutant plant may be created by mutagenizing plant seeds; e.g., by chemical mutagenesis (EMS) or radiation, and selecting the mutants by PCR amplification and sequencing the mutant PCR product. The mutant plant may be created by using mutagenesis and screening strategies such as Targeted Induced Local Lesions In Genomics (TILLING; Sikora et al. 2011), T-DNA insertion and transposon-based mutagenesis (An et al. 2005), genome editing strategies involving nucleases such as zinc-finger nucleases (Wrigyt et al. 2005), TAL effector nucleases (Christian et al. 2010), or intein-derived meganucleases (Wehrkamp-Richter et al. 2009). The references cited are incorporated herein as if fully set forth.

In an embodiment, the genetically engineered plant may include any isolated nucleic acid sequence, amino acid sequence, one or more genetic construct, or one or more vectors described herein.

An embodiment includes a method of altering vegetative starch levels in a plant. The method may include expressing an isolated nucleic acid in the plant. Expression of the isolated nucleic acid in the plant may alter the activity of at least one enzyme related to starch metabolism in the plant. The plant may be any genetically engineered plant herein. The genetically engineered plant may include any one or more genetic construct described herein.

Any genetically engineered plant herein may be provided in a method of agricultural processing or animal feed applications. The genetically engineered plant may include any one or more genetic construct described herein. A first isolated nucleic acid that encodes a product that inactivates or inhibits expression of at least one gene encoding a protein involved in mobilization of starch in a plant, and a second isolated nucleic acid that encodes at least one polysaccharide degrading enzyme in the genetically engineered plant may be expressed at any point in the method. The first isolated nucleic acid and the second isolated nucleic acid may be expressed prior to the step of processing the plant. The first isolated sequence and the second isolated sequence may be expressed during the step of processing the plant. The expression may be induced. Upon the expression of the first and the second nucleic acids, the genetically engineered plant may have an altered level of vegetative starch compared to the level of starch in a non-genetically engineered plant of the same genetic background but lacking the one or more genetic construct.

A step of providing the genetically engineered plant may include obtaining it from another party that produced it. A step of providing may include making the transgenic plant. A step of providing may include making the mutant plant. The step of providing may include genetically engineering the plant by contacting the plant with any one of the genetic constructs herein. The step of providing may include stable transformation of the plant by any of the methods described herein, or known methods. The step of providing may include genetically engineering the plant by cleaving a gene encoding a protein involved in starch metabolism at a cleavage site recognized by a restricting enzyme transiently expressed in the plant after contacting the plant with a genetic construct comprising a first nucleic acid encoding the restricting enzyme. The step of providing may also include regenerating the genetically engineered plant from a tissue of the transgenic or mutant plant having an altered level of vegetative starch. The step of providing may include obtaining a progeny of genetically engineered plant resulted from self-pollination or cross-pollination between the genetically engineered plant and non-genetically engineered plant. The genetically engineered plant may be used in a variety of subsequent methods or uses. The step of providing may include procuring the genetically engineered plant. The step of providing may include making the genetically engineered plant available for further processing steps.

The genetically engineered plant may be provided in a method of agricultural processing as a feedstock engineered with elevated levels of starch and/or expressing one or more polysaccharide degrading enzyme. The feedstock may include any genetically engineered plant herein alone or in combination with other components. The other components may include other plant material. Agricultural processing is the manipulation or conversion of any agricultural feedstock for a particular product or use. Agricultural processing may include drying the genetically engineered plant. Agricultural processing may include fermenting the genetically engineered plant. Agricultural processing may include hydrolyzing the genetically engineered plant by one or more an exogenous enzymes to obtain a biochemical product.

The genetically engineered plant may be provided in a method of preparing animal feed. Preparing animal feed may include combining the genetically engineered plant with distillers grains. Preparing animal feed may include pelletizing the genetically engineered plant into feed pellets. Preparing animal feed may include ensiling the genetically engineered plant to make silage.

Preparing animal feed may include combing the genetically engineered plant with a source of edible fiber.

Agricultural processing or preparing animal feed may also include at least one of the operations of harvesting, baling, grinding, milling, chopping, size reducing, crushing, extracting a component from the feedstock, purifying a component or portion of the feedstock, extracting or purifying starch, hydrolyzing polysaccharides into oligosaccharides or monosaccharides, chemical conversion, or chemical catalysis of the feedstock.

In an embodiment of the method of agricultural processing, the genetically engineered plant may be used for producing a chemical product. The method may include pretreating a genetically engineered plant with a chemical formulation to form a mixture. The chemical formulation may include one or more moiety including but not limited to an ion of sulfite, bisulfite, sulfate, carbonate, hydroxide or oxide. The chemical formulation may further include one or more counter ion including but not limited to ammonium, sodium, magnesium or calcium.

In an embodiment, the chemical formulation may include but is not limited to one compound selected from a sulfuric acid, a base, ammonium bisulfite and ammonium carbonate. The ammonium bisulfite may be at a concentration of 0.02 M to 0.35 M. The ammonium carbonate may be at a concentration of 0.025 M to 0.25 M. The sulfuric acid may be at concentration of 0.25 M. The base may be 7.5% ammonium hydroxide.

In an embodiment, the chemical formulation and the genetically engineered plant may be admixed with other plant material at an optimal liquid-to-solid ratio in a mixture. The mixture may have a liquid to solid ratio selected from the value of less than or equal to one of 10, 9, 8, 7, 6, 5, 4, 3, 2, or 1, or any value in a range between any two of the foregoing (endpoints inclusive).

Pretreating may include incubating the mixture for any period of time. Pretreating may include incubating the mixture for up to 16 hours. Incubating may occur for longer or shorter periods may be performed. Pretreating may include incubating the mixture for a period of less or equal to one of 16, 15, 14, 13, 12, 11, 10, 9, 8, 7, 6, 5, 4, 3, 2, or 1 hour(s).

Pretreating may include providing a mixture temperature of 40° C. to 150° C. A mixture temperature of 40° C. to 95° C. may allow breakage or removal of portions of lignin within the lignocellulosic material in the mixture without deactivating hydrolytic enzymes. Pretreating may include providing a mixture temperature of 40° C., 55° C., 65° C., 75° C., 95° C., 150° C., less than 55° C., less than 65° C., less than 75° C., less than 95° C., less than 150° C., 40° C. to 55° C., 40° C. to 65° C., 40° C. to 75° C., 40° C. to 95° C., 40° C. to less than 150° C., 55° C. to 65° C., 55° C. to 75° C., 55° C. to 95° C., 55° C. to less than 150° C., 65° C. to 75° C., 65° C. to 95° C., 65° C. to less than 150° C., 75° C. to 95° C., 75° C. to less than 150° C., or 95° C. to less than 150° C.

Pretreating may include providing a mixture pH ranging from 1.0 to 12.0. Pretreating may include providing a mixture pH within a range of 6.5 to 8.5. The mixture pH provided may be 1.0, 1.5, 2.0, 2.5, 3.0, 3.5, 4.0, 4.5, 5.0, 5.5, 6.0, 7.0, 7.5, 8.0, 9.0, 9.5, 10, 10.5, 11.0, 11.5 or 12.0, or a pH within a range between any two of the foregoing pH values (endpoints inclusive). The pH of the mixture during pretreating may depend on the type of chemical used and/or type of plant material used. Providing a mixture pH may include adding a pH modifying chemical. A pH modifying chemical may be an acid or an alkali.

In an embodiment, the method of agricultural processing may further include hydrolyzing the mixture. Hydrolyzing may include incubating the mixture for a period 144 hours, 140 hours, 130 hours, 120 hours, 110 hours, 100 hours, 90 hours, 80 hours, 70 hours, 60 hours, 50 hours, 40 hours, 30 hours, 20 hours, 10 hours, 9 hours, 8 hours, 7 hours, 6 hours, 5 hours, 4 hours, 3 hours, 2 hours, 1 hour, less than 144 hours, less than 140 hours, less than 130 hours, less than 120 hours, less than 110 hours, less than 100 hours, less than 90 hours, less than 80 hours, less than 70 hours, less than 60 hours, less than 50 hours, less than 40 hours, less than 30 hours, less than 20 hours, less than 10 hours, less than 9 hours, less than 8 hours, less than 7 hours, less than 6 hours, less than 5 hours, less than 4 hours, less than 3 hours, less than 2 hours, or less than 1 hour.

In an embodiment, the step of hydrolyzing may include providing a mixture temperature of 100° C. or less, 65° C. or less, 50° C. or less, 48° C. to 50° C., 48° C. to 65° C., 48° C. to less that 100° C., or 48° C. to 100° C. The step of hydrolyzing may include providing a pH ranging from 4.8 to 5.0, a pH of 4.8, a pH of 4.9, or a pH of 5.0. At least one of the temperature, pH, or time of treatment, may be selected based on the specific activity of a polysaccharide degrading enzyme in the genetically engineered plant.

If the genetically engineered plant includes multiple polysaccharide degrading enzymes, the step of hydrolyzing may sequentially provide conditions optimal for at least one of expression, pretreating, or hydrolysis by each of the multiple polysaccharide degrading enzymes. The step of hydrolyzing may include providing a pH optimal for activity of one enzyme, followed by a different pH optimal for activity of another enzyme. The step of hydrolyzing may include adjusting temperatures at different periods of time for optimal activity of each enzyme. For example, a cellobiohydrolase may require a different temperature or pH than a xylanase.

The method of agricultural processing may include adding one or more exogenous enzymes to at least one of the genetically engineered plant, other plant material, or the mixture. The exogenous enzymes may be added before, during, or after pretreating. The exogenous enzymes may be added before, during, or after the step of hydrolyzing. One or more exogenous enzymes may be provided in an enzyme cocktail. An enzyme cocktail may include one or more polysaccharide degrading enzymes. A polysaccharide degrading enzyme provided in an embodiment herein may be but is not limited to a lignin degrading enzyme, a cellulose degrading enzyme, or a hemicellulose degrading enzyme. A polysaccharide degrading enzyme provided in an embodiment herein may be but is not limited to one selected from glycosidases, xylanases, cellulases, endoglucanases, exoglucanases, cellobiohydrolases, β-xylosidases, feruloyl esterases, β-glucosidases, and amylases. An enzyme cocktail may include a cellulase isolated from *Trichoderma reesii*. An enzyme cocktail may be purchased from a vendor. An enzyme cocktail may be, but is not limited to, Accellerase® 1000, Accellerase® 1500, Accelerase® TRIO™, and Accellerase®XY available from Genencor International (Rochester, N.Y.). An enzyme cocktail may be Cellic, CTEC, HTEC available from Novozymes (Denmark). An enzyme cocktail may include different classes of polysaccharide degrading enzymes. An enzyme cocktail may include starch degrading enzymes. An enzyme cocktail may include an amylase or an invertase. Optimal conditions for different classes of polysaccharide degrading enzymes in a cocktail may be provided. For example, the temperature, pH and time of treatment for hydrolysis may be adjusted during the method to provide optimal conditions for different enzymes in the cocktail.

The method of agricultural processing may further include contacting the mixture and/or products of hydrolysis with a fermenting organism to produce a chemical product. After enzymatic hydrolysis, soluble sugars may be recovered and used for production of a chemical product. The chemical product may be glucose. Alternatively, simultaneous saccharification and fermentation of soluble sugars into a chemical product may be performed in the method. A chemical product may be but is not limited to butane, butanediol, butadiene, butanol, isobutanol, propane, propanediol, propylene, propanol, isopropanol, methane, methanol, ethanol, phenol, glycerol, ethylene, toluene, ethyl, benzene, styrene, xylene, ethylene glycol, ethylene oxide, formic acid, carbone dioxide, formaldehyde, acetaldehyde, acetone, a vitamin, ethane, pentane, hexane, heptane, octane, benzene, acetic acid, sorbitol, arabinitol, succinic acid, fumaric acid, malic acid, furan dicarboxylic acid, aspartic acid, glucaric acid, glutamic acid, itaconic acid, levulinic acid, hydroxybutyrolactone, glycerol, sorbitol, xylitol, arabinitol, gluconic acid, lactic acid, malonic acid, propionic acid, citric acid, aconitic acid, xylonic acid, furfural, levoglucosan, alanine, proline, lysine, serine, or threonine (See T. Werpy and G. Petersen, *Top Value Added Chemicals From Biomass*, Volume 1, Results of Screening for Potential Candidates from Sugars and Synthesis Gas, August 2004, Report, PNNL & NREL, which is incorporated herein by reference as if fully set forth).

The conversion of sugars into a chemical product may be performed by any suitable fermenting organism. The fermenting organism may be selected based on the desired chemical product. The fermenting organism may be yeast. The yeast may be but is not limited to one of *Saccharomyces, Kluyveromyces, Pichia, Yarrowia, Spathaspora* or *Scheffersomyces* ssp. The fermenting organism may be a bacterium. A bacterium may be but is not limited to a *Zymomonas, Escherichia, Bacillus, Lactobacillus*, or *Clostridium* spp. The fermenting organism may be a wild type organism or a genetically engineered recombinant organism. The fermenting organism may be a collection of organisms isolated from a ruminant animal. The fermenting organism may be an acetogen.

The method of agricultural processing may include simultaneous saccharification and fermentation of soluble sugars to produce ethanol. Simultaneous saccharification and fermentation to produce ethanol may include providing *Saccharomyces cerevisiae* D5A before, during or after pretreating or providing hydrolysis conditions.

An embodiment provides a method of preparing the genetically engineered plant to be used as an animal feed. The method may include a step of contacting the genetically engineered plant with liquid to form a mixture and incubating the mixture at a temperature of 40° C. to 100° C. for a time sufficient to produce soluble sugars from lignocellulosic material in the mixture. The liquid may be water. A mixture temperature of 40° C. to 95° C. may allow breakage or removal of lignin within the lignocellulosic material in the mixture without deactivating one or more CWDEs included in the genetically engineered plant.

In an embodiment, the method of preparing the animal feed may further include contacting the mixture with an alkaline chemical. The alkaline chemical may be but is not limited to calcium oxide, calcium hydroxide, potassium hydroxide, sodium hydroxide, hypochlorite, hydrogen peroxide and ammonia. The step of contacting may occur in a vessel and may include rotating and mechanical grinding the mixture in the vessel.

In an embodiment, the method of preparing the animal feed may further include adding to the mixture one or more enzymes for enzymatic hydrolysis of lignocellulosic material. The added enzymes may be but are not limited to one selected from amylases, proteases, phytases, hydrolytic enzymes, cellulases, glucanases, hemicellulases, xylanases, amylases, esterases, laccases, mannanases, and peroxidases.

In an embodiment, the method of preparing the animal feed may include combining the mixture with a source of edible fiber. The source of edible fiber may be but is not limited to corn, sorghum, wheat, rye, soybeans, switchgrass, grasses, corn grain, sorghum grain, wheat grain, wheat straw, rye grain, corn fiber, corn stove, corn husks, soybean meal, corn meal, corn oil, wheat germ, corn germ, or combination thereof.

In an embodiment, the method of preparing the animal feed may include combining the mixture with distillers grains. Distillers grains may be created in distilleries as byproducts in breweries and ethanol producing plants. Distillers grains may be used as fodder for livestock.

In an embodiment, the method of preparing the animal feed may include pelletizing the genetically engineered plants into feed pellets. The pelletizing may be performed by any known methods. In an embodiment, the genetically engineered plants may be shredded in traditional shredders used in pellet manufacturing. The shredded material may be further ground to produce particles ranging in size from 0.5 inches to 6 inches. The particles may be used for producing pellets.

In an embodiment, the method of preparing the animal feed may include ensiling the genetically engineered plants to make silage. As used herein, silage is fermented, high moisture fodder that can be fed to ruminant animals, in particular to dairy cattle, sheep and horses. Silage may be made by placing green parts of plants in a silo and by piling it in a heap covered by a plastic film. Silage retains more nutrients than dried plants, hay, or stover. Silage goes through a bacterial fermentation process resulted in production of volatile fatty acids and improved digestability for ruminant animals. The method may also include the addition of ensiling agents to improve stability or digestability of the ensiled genetically engineered plant. The ensiling agent may be but is not limited to sugars, lactic acid or inculants.

In an embodiment of the method of preparing the animal feed, the genetically engineered plants may be used to obtain a digestable feedstock. The method may also include feeding an animal with a digestable feedstock comprising the genetically engineered plants to promote animal growth. The animal may be but is not limited to chicken, swine, or cattle.

Further embodiments herein may be formed by supplementing an embodiment with one or more element from any one or more other embodiment herein, and/or substituting one or more element from one embodiment with one or more element from one or more other embodiment herein.

EXAMPLES

The following non-limiting examples are provided to illustrate particular embodiments. The embodiments throughout may be supplemented with one or more detail from one or more example below, and/or one or more element from an embodiment may be substituted with one or more detail from one or more example below.

Example 1

Identifying Target Genes

T-DNA insertion libraries from different organisms may be researched to locate genes in those organisms related to starch regulation. Based on the discovery of such genes, a search may be conducted to find similar genes in a plant of interest. The genes of interest may be used in constructs herein to affect alteration in starch regulation.

A number of other methods have been developed to generate or identify null alleles among genes. Among these are TILLING (Till B J, Cooper J, Tai T H, Colowit P, Greene E A, Henikoff S, Comai L Discovery of chemically induced mutations in rice by TILLING (2007) BMC Plant Biol. 7:19), and gene tagging with Tos17 retrotranspsons or engineered maize (*Zea mays*) Ac and Ds/dSpm transposons (Krishnan A, Guiderdoni E, An G, Hsing Y I, Han C D, Lee M C, Yu S M, Upadhyaya N, Ramachandran S, Zhang Q, Sundaresan V, Hirochika H, Leung H, Pereira A. 2009. Mutant resources in rice for functional genomics of the grasses. Plant Physiol. 149:165-70 and references therein), which are incorporated herein by reference as if fully set forth. These methods may be used to generate or identify null alleles among genes related to starch regulation.

Once genes that encode key enzymes involved in the turnover of transitory starch in example crops were identified, candidate genes in rice, maize, and sorghum that encode enzymes involved in starch turnover were identified by their homology to genes that encode the corresponding enzymes in species that have been better studied. For example, CLUSTAL amino acid alignments between hypothetical glucan water dikinase (GWD) sequences that have been inferred from draft genome sequences from sorghum (SbGWD; SEQ ID NO: 1), maize (ZmGWD; SEQ ID NO: 2) and rice (OsGWD; SEQ ID NO: 3) and the known GWD enzyme sequence from potato (StGWD; SEQ ID NO: 4) show extensive homology among these polypeptides:

```
CLUSTAL 2.1 multiple sequence alignment
SbGWD   ----------MTGFSAAASAAAAAERCALAIRARPAASSPAKRQQQSASLRRSGGQRRPT    50
ZmGWD   ------------------------------------------------------------
OsGWD   -------------------------------------------------------PAATT     5
StGWD   MSNSLGNNLLYQGFLTSTVLEHKSRISPPCVGGNSLFQQQVISKSPLSTEFRGNRLKVQK    60

SbGWD   TLAASRRSPVVVPRAIATSADRASHDLVGKFTLDSNSELLVAVNPAPQGLVSVIGLEVTN   110
ZmGWD   ------------------------------------------------------------
OsGWD   TLAVSRRS-LLAPRAIAASTGRASPGLVGRFTLDANSELKVTLNPAPQGSVVEINLEATN    64
StGWD   KKIPMEKKRAFSSSPHAVLTTDTSSELAEKFSLGGNIELQVDVRPPTSGDVSFVDFQVTN   120

SbGWD   TSGSLILHWGVLRPDKRDWILPSRQPDGTTVYKNRALRTPFVKSGDNSTLRIEIDDPAVQ   170
ZmGWD   -----------------------PDGTTVYKNRALRTPFVKSGDNSTLRIEIDDPGVH    35
OsGWD   TSGSLILHWGALRPDRGEWLLPSRKPDGTTVYKNRALRTPFIKSGDNSTLKIEIDDPAVQ   124
StGWD   GSDKLFLHWGAVKFGKETWSLPNDRPDGTKVYKNKALRTPFVKSGSNSILRLEIRDTAIE   180
                            ****.****.******.***.**  *.:.** *...:.

SbGWD   AIEFLIFGETQNKWFKNNGQNFQIQLQSSRHQGNGASGASSSATSTLVPEDLVQIQAYLR   230
ZmGWD   AIEFLIFDETQNKWFKNNGQNFQVQFQSSRHQGTGASGASSSATSTLVPEDLVQIQAYLR    95
OsGWD   AIEFLIFDEARNNWYKNNGQNFQIQLQASQYQGQGTSTATS---STVVPEDLVQIQSYLR   181
StGWD   AIEFLIYDEAHDKWIKNNGGNFRVKLSRKEIRGP----------DVSVPEELVQIQSYLR   230
        ******:.*:::.*.****.**::::. .. :*         .. ***:*****.:***

SbGWD   WERKGKQSYTPEQEKEEYEAARAELIEELNRGVSLEKLRAKLTKTPEAPESDERKSPASR   290
ZmGWD   WERRGKQSYTPEQEKEEYEAARAELIEEVNRGVSLEKLRAKLTKAPEAPESDESKSSASR   155
OsGWD   WERKGKQSYTPEQEKEEYEAARTELIEELNKGVSLEKLRAKLTKTPEATDSNAPASEST-   240
StGWD   WERKGKQNYPPEKEKEEYEAARTVLQEEIARGASIQDIRARLTKTNDKSQSKEEPLHVT-   289
        ***:***.*.**:*********:  * **: .*.*.:::.**.***:    : ..*.     :

SbGWD   MPVDKLPEDLVQVQAYIRWEKAGKPNYPPEKQLVELEEARKELQAEVDKGISIDQLRQKI   350
ZmGWD   VPIGKLPEDLVQVQAYIRWEQAGKPNYPPEKQLVEFEEARKELQAEVDKGISIDQLRQKI   215
OsGWD   -VTTKVPEELVQVQAYIRWEKAGKPNYAPEKQLVEFEEARKELQSELDKGTSVEQLRNKI   299
StGWD   --KSDIPDDLAQAQAYIRWEKAGKPNYPPEKQIEELEEARRELQLELEKGITLDELRKTI   347
          .:*.:*.*.******.******.****: *:****.*** *::*** :::.**:.*

SbGWD   LKGNIESKVSKQLKNKKYFSVERIQRKKRDIMQLLSKHKHT--VMEEKVEVAPKQPTVLD   408
ZmGWD   LKGNIESKVSKQLKNKKYFSVERIQRKKRDITQLLSKHKHT--VMEDKVEVVPKQPTVLD   273
OsGWD   LKGNIETKVSKQLKDKKYFSVERIQRKKRDIVQLLKKHKPT--VMEAQVET-PKQPTVLD   356
StGWD   TKGEIKTKVEKHLK-RSSFAVERIQRKKRDFGHLINKYTSSPAVQVQKVLEEPPALSKIK   406
         **:*.::**.*.**  :. *.**********:  :*:. *:..  : *   :* *    : :.

SbGWD   LFTKSLHEKDGCEVLSRKLFKFGDKEILAISTKVQNKTEVHLATNHTEPLILHWSLAKKA   468
ZmGWD   LFTKSLHEKDGCEVLSRKLFKFGDKEILAISTKVQNKTEVHLATNHTDPLILHWSLAKNA   333
OsGWD   LFTKSLQEQDNCEVLSRKLFKFGDKEILGITTVALGKTKVHLATNYMEPLILHWALSKEN   416
StGWD   LYAKEKEEQIDDPILNKKIFKVDDGELLVLVAKSSGKTKVHLATDLNQPITLHWALSKSP   466
        *::*. .*: . :*.:***.* *:*  :  .**:****: :*: ***.*:*.

SbGWD   GEWKAPPSNILPSGSKLLDMACETEFTRSELDGLC--YQVVEIELDDGGYKGMPFVLRSG   526
ZmGWD   GEWKAPSPNILPSGSTLLDKACETEFTKSELDGLH--YQVVEIELDDGGYKGMPFVLRSG   391
OsGWD   GEWQAPPSSILPSGSSLLDKACETSFSEYELNGLH--CQVVEIELDDGGYKRMPFVLRSG   474
StGWD   GEWMVPPSSILPPGSIILDKAAETPFSASSSDGLTSKVQSLDIVIEDGNFVGMPFVLLSG   526
        *** .*...***.**.** :** *.** *:   .**   *..*.:**.:  ***** **

SbGWD   ETWIKNNGSDFFLDFSTRDTRNIK--LKDNGDAGKGTAKALLERIADLEEDAQRSLMHRF   584
ZmGWD   ETWIKNNGSDFFLDFSTHDVRNIKAILKDNGDAGKGTSKALLERIADLEEDAQRSLMHRF   451
OsGWD   ETWMKNNGSDFYLDFSTKVAKNTK----DTGDAGKGTAKALLERIADLEEDAQRSLMHRF   530
StGWD   EKWIKNQGSDFYVGFSAASKLALK-----AAGDGSGTAKSLLDKIADMESEAQKSFMHRF   581
        *.*:**:****::.**:.:  .*        .*.*:***:**::***:*.:**:*:****

SbGWD   NIAADLADEARDAGLLGIVGLEVWIRFMATRQLTWNKNYNVKPREISKAQDRFTDDLENM   644
ZmGWD   NIAADPADQARDAGLLGIVGLFVWIRFMATRQLTWNKNYNVKPREISKAQDRFTDDLENM   511
```

```
OsGWD  NIAADLVDQARDNGLLGIIGIFVWIRFMATRQLIWNKNYNVKPREISKAQDRFTDDLENM   590
StGWD  NIAADLIEDATSAGELGFAGILVWMRFMATRQLIWNKNYNVKPREISKAQDRLTDLLQNA   641
       *****  ::*  . * **: *:.**.*******  ******************.** *:*

SbGWD  YRTYPQYREILRMIMAAVGRGGEGDVGQRIRDEILVIQRNNDCKGGMMEEWHQKLHNNTS   704
ZmGWD  YKTYPQYREILRMIMAAVGRGGEGDVGQRIRDEILVIQRNNDCKGGMMEEWHQKLHNNTS   571
OsGWD  YRTYPQYQEILRMIMSAVGRGGEGDVGQRIRDEILVIQRNNDCKGGMMEEWHQKLHNNTS   650
StGWD  FTSHPQYREILRMIMSTVGRGGEGDVGQRIRDEILVIQRNNDCKGGMMQEWHQKLHNNTS   701
       : ::***:*******::******************************:***********

SbGWD  PDDVVICQALIDYIKNDFDISVYWDTLNKNGITKERLLSYDRAIHSEPNFRSEQKEGLLR   764
ZmGWD  PDDVVICQALIDYIKSDFDISVYWDTLNKNGITKERLLSYDRAIHSEPNFRSEQKAGLLR   631
OsGWD  PDDVVICQALLDYIKSDFDIGVYWDTLKKDGITKERLLSYDRPIHSEPNFRSEQKDGLLR   710
StGWD  PDDVVICQALIDYIKSDFDLGVYWKTLNENGITKERLLSYDRAIHSEPNFRGDQKGLLR   761
       **********:****:***.****:**:::.**********.*********.:**.****

SbGWD  DLGNYMRSLKAVHSGADLESAIATCMGYKSEGEGFMVGVQINPVKGLPSGFPELLEFVLD   824
ZmGWD  DLGNYMRSLKAVHSGADLESAIASCMGYKSEGEGFMVGVQINPVKGLPSGFPELLEFVLE   691
OsGWD  DLGNYMRSLKAVHSGADLESAIATCMGYKSEGEGFMVGVQINPVKGLPSGFPKLLEFVLD   770
StGWD  DLGHYMRTLKAVHSGADLESAIANCMGYKTEGEGFMVGVQINPVSGLPSGFQDLLHFVLD   821
       ***:***:***************.*****:************* .******:.**.***:

SbGWD  HVEDKSAEPLLEGLLEARVDLRPLLLDSPERMKDLIFLDIALDSTFRTAIERSYEELNDA   884
ZmGWD  HVEDKSAEPLPEGLLEARVELRPLLLDSRERMKDLIFLDIALDSTFRTAIERSYEELNDA   751
OsGWD  HVEDKSAEPLLEGLLEARAELHPLLLGSPERMKDLIFLDIALDSTFRTAVERSYEELNNV   830
StGWD  HVEDKNVETLLERLLEAREELRPLLLKPNNRLKDLLFLDIALDSTVRTAVERGYEELNNA   881
       *****. .*.* * ***** *:****  . :*:***:********.***:***.*****::

SbGWD  APEKIMYFISLVLENLAFSIDDNEDILYCLKGWNQALEMAKQKDDQWALYAKAFLDRIRL   944
ZmGWD  APEKIMYFISLVLENLALSIDDNEDILYCLKGWNQALEMAKQKDDQWALYAKAFLDRNRL   811
OsGWD  EPEKIMYFISLVLENLALSTDDNEDILYCLKGWNQALEMAKQKNNQWALYAKAFLDRTRL   890
StGWD  NPEKIMYFISLVLENLALSVDDNEDLVYCLKGWNQALSMSNGGDNHWALFAKAVLDRTRL   941
        *****************:*.*****::********:*:. :: ::***:***:***.**

SbGWD  ALASKGEQYHNMMQPSAEYLGSLLSIDKWAVNIFTEEIIRGGSAATLSALLNRFDPVLRN   1004
ZmGWD  ALASKGEQYHNMMQPSAEYLGSLLSIDQWAVNIFTEEIIRGGSAATLSALLNRFDPVLRN   871
OsGWD  ALASKGEQYYNLMQPSAEYLGSLLNIDQWAVNIFTEEIIRGGSAATLSALLNRIDPVLRN   950
StGWD  ALASKAEWYHHLLQPSAEYLGSILGVDQWALNIFTEEIIRAGSAASLSSLLNRLDPVLRK   1001
       *****.*  *:::*********:*.:*:**:*********.****:**:****:*****:

SbGWD  VANLGSWQVISPVEVSGYVVVVDELLAVQNKSYDKPTILVAKSVKGEEEIPDGVVGVITP   1064
ZmGWD  VAHLGSWQVISPVEVSGYVVVVDELLAVQNKSYDKPTILVAKSVKGEEEIPDGVVGVITP   931
OsGWD  VAQLGSWQVISPVEVSGYIVVVDELLAVQNKSYDKPTILVAKSVKGEEEIPDGVVGVITP   1010
StGWD  TANLGSWQIISPVEAVGYVVVVDELLSVQNEIYEKPTILVAKSVKGEEEIPDGAVALITP   1061
       .*:*****:*****..**:******:**::.*:****************** .*.:***

SbGWD  DMPDVLSHVSVRARNSKVLFATCFDHTTLSELEGYDQKLLSFKPTSADITYREITESELQ   1124
ZmGWD  DMPDVLSHVSVRARNSKVLFATCFDHTTLSELEGYDQKLFSFKPTSADITYREITESELQ   991
OsGWD  DMPDVLSHVSVRARNCKVLFATCFDPNTLSELQGHDGKVFSFKPTSADITYREIPESELQ   1070
StGWD  DMPDVLSHVSVRARNGKVCFATCFDPNILADLQAKEGRILLLKPTSDIIYSEVNEIELQ   1121
       ***************  ** ****** . *::*:.. :  :::  :***:**  * .  * ***

SbGWD  QSSSPNAEVGHAVPSISLAKKKFLGKYAISAEEFTEEMVGAKSRNIAYLKGKVPSWVGVP   1184
ZmGWD  QSSSPNAEVGHAVPSISLAKKKFLGKYAISAEEFSEEMVGAKSRNIAYLKGKVPSWVGVP   1051
OsGWD  -SGSLNAEAGQAVPSVSLVKKKFLGKYAISAEEFSEEMVGAKSRNIAYLKGKVPSVGIP   1129
StGWD  --SSSNLVEAETSATLRLVKKQFGGCYAISADEFTSEMVGAKSRNIAYLKGKVPSSVGIP   1179
         .* *    .  .:: .::  **:*:*  *.****::**:.**********:*******:

SbGWD  TSVAIPFGTFEKVLSDGLNKEVAQTIEKLKIRLAQEDFSALGEIRKAVLNLTAPMQLVNE   1244
ZmGWD  TSVAIPFGTFEKVLSDGLNKEVAQSIEKLKIRLAQEDFSALGEIRKVVLNLTAPMQLVNE   1111
OsGWD  TSVAIPFGTFEKVLSDEINKEVAQTIQMLKGKLAQDDFSALGEIRKTVLNLTAPTQLIKE   1189
StGWD  TSVALPFGVFEKVLSDDINQGVAKELQILMKKLSEGDFSALGEIRTTVLDLSAPAQLVKE   1239
       ****:***.*******  *::.**:  : * ::  :.:::*******    **:*:**  ** **::*

SbGWD  LKERMLGSGMPWPGDEGNRRWEQAWMAIKKVWASKWNERAYFSTRKVKLNHEYLSMAVLV   1304
ZmGWD  LKERMLGSGMPWPGDEGDKRWEQAWMAIKKVWASKWNERAYFSTRKVKLDHEYLSMAVLV   1171
OsGWD  LKEKMLGSGMPWPGDEGDQRWEQAWMAIKKVWASKWNERAYFSTRKVKLDHDYLSMAVLV   1249
StGWD  LKEKMQGSGMPWPGDEGPKRWEQAWMAIKKVWASKWNERAYFSTRKVKLDHDYLCMAVLV   1299
       ***.* ***********  *****************************.*::* *****

SbGWD  QEVVNADYAFVIHTTNPSSGDSSEIYAEVVKGLGETLVGAYPGRAMSFVCKKDDLDSPKL   1364
ZmGWD  QEVVNADYAFVIHTTNPSSGDSSEIYAEVVKGLGETLVGAYPGRAMSFVCKKDDLDSPKL   1231
OsGWD  QEIVNADYAFVIHTTNPSSGDSSEIYAEVVKGLGETLVGAYPGRAMSFVCKKNDLDSPKV   1309
StGWD  QEIINADYAFVIHTTNPSSGDDSEIYAEVVKGLGETLVGAYPGRALSFICKKKDLNSPQV   1359
       **::**************** *********************** *::***: **.**::

SbGWD  LGYPSKPIGLFIRRSIIFRSDSNGEDLEGYAGAGLYDSVPMDEEDEVVLDYTTDPLIVDR   1424
ZmGWD  LGYPSKPIGLFIRQSIIFRSDSNGEDLEGYAGAGLYDSVPMDEEDEVVLDYTTDPLIVDR   1291
OsGWD  LGFPSKPIGLFIKRSIIFRSDSNGEDLEGYAGAGLYDSVPMDEEDEVILDYTTDPLITDQ   1369
StGWD  LGYPSKPIGLFIKRSIIFRSDSNGEDLEGYAGAGLYDSVPMDEEEKVVIDYSSDPLITDG   1419
       **:*********::**************************.::.:**:***::****: *
```

```
SbGWD  GFRNSILSSIARAGHAIEELYGSPQDVEGVVKDGKIYVVQTRPQM  1469  (SEQ ID NO: 1)
ZmGWD  GFRSSILSSIARAGHAIEELYGSPQDVEGVVKDGKIYVVQTRPQM  1336  (SEQ ID NO: 2)
OsGWD  GFQKSILSSIARAGHAIEELYGSPQDVEGAVKEGKLYVVQTRPQM  1414  (SEQ ID NO: 3)
StGWD  NFRQTILSNIARAGHAIEELYGSPQDIEGVVRDGKIYVVQTRPQM  1464  (SEQ ID NO: 4)
       .*:.:***.******************:**.*:.**:*********
```

Based on this homology, it is possible to identify gene sequences (including coding sequences which had been previously unannotated in public databases) that correspond the GWD enzymes from the genomes of the respective species. These sequences include putative GWD cDNA (coding) sequences from sorghum (SEQ ID NO: 5), maize (SEQ ID NO: 6), and rice (SEQ ID NO:7), the corresponding genes from which the GWD mRNAs are transcribed for GWD from sorghum (SEQ ID NO: 8) and maize (SEQ ID NO: 9). Furthermore, from this information, one can also infer the sequences of the 5' untranslated regions (UTRs) and promoters of the respective GWD genes in sorghum (SEQ ID NO: 10) and maize (SEQ ID NO: 11), as well as the 3' UTRs of the respective GWD genes in sorghum (SEQ ID NO: 12) and maize (SEQ ID NO: 13). The SbGWD gene is located on sorghum chromosome 10 of sorghum and consists of a 12128 bp sequence (ATG to Stop), while the 11693 bp ZmGWD gene is located on chromosome 6 of maize. The overall sequence identity between the two genes is 78.3%, while the inferred cDNA sequences are 95.6% identical. Each gene is composed of 32 exons of identical length interrupted by 31 introns, which differ not considerably in size. The deduced 1471 amino acid (AA) ZmGWD and 1469AA SbGWD proteins share 94.4% sequence identity at the amino acid level. Both proteins are characterized by the presence of the PPDK_N domain (Pyruvate phosphate dikinase, PEP/pyruvate binding) in the 1267-1470AA region of ZmGWD and 1265-1468AA of SbGWD. The other notable characteristic of the two proteins is the presence of a conserved His residue at 1074AA in ZmGWD and at 1072AA in SbGWD, which is required for phosphorylation activity.

Similar strategies can be used to identify gene sequences for other target enzymes in sorghum and maize. CLUSTAL alignment as follows was used to identify candidate PWD target proteins from sorghum (SbPWD; SEQ ID NO: 14) and maize (ZmPWD; SEQ ID NO: 15) based on their similarity to the known PWD protein from *Arabidopsis thaliana* (AtPWD; SEQ ID NO: 16).

```
CLUSTAL 2.1 multiple sequence alignment
SbPWD  MASLRPFDPSLAARPGPPPPARPAARRPVPAPPLAAPFASALIFPVRPRIPGRTRGTGVA   60
ZmPWD  ------------------------------------------------------------
AtPWD  -------MESIGSHCCSSPFTFITRNSSSSLPRLVN--ITHRVNLSHQSHRLRNSNSRLT   51

SbPWD  ASTKHITRTKEEKQTDPSKQDIVRLHVCLDHQVMFGEHVGIIGSAKELGSWKSPVEMDWT  120
ZmPWD  ------------------------------------------------------------
AtPWD  RTATSSSTIEEQRKKKDGSGTKVRLNVRLDHQVNFGDHVAMFGSAKEIGSWKKKSPLNWS  111

SbPWD  PNGWVCQLDLPGETLLEFKFVVFLNRGKDKIWEDGDNRVVNLPKNGSFDMACHWNKTKEP  180
ZmPWD  ------------------------------------------------------------
AtPWD  ENGWVCELELDGGQVLECKFVIVKNDG-SLSWESGDNRVLKVPNSGNFSVVCHWDATRET  170

SbPWD  LNLLGTS-EIKLSGDTEKEKDEDAKLSRNIALEEMGNISNAGDGDLTPKLESSTLGGLWQ  239
ZmPWD  ------------------------------------------------------------
AtPWD  LDLPQEVGNDDDVGDGGHERDNHDVGDDRVVGSENG-----------AQLQKSTLGGQWQ  219

SbPWD  GSDTVFMRSNEHRNNESDRKWDMTGLDAVSLKLVEGDKASRNWWRKLELVRGLVSEYVHD  299
ZmPWD  ------------------------------------------------------------
AtPWD  GKDASFMRSNDHGNREVGRNWDTSGLEGTALKMVEGDRNSKNWWRKLEMVREVIVGSVER  279

SbPWD  QSHLEALTYSAIYLKWIYTGQIPCFEDGGHHRPNKHAEISRQIFREIERIYYGENTSAQD  359
ZmPWD  ------------------------------------------------------------
AtPWD  EERLKALIYSAIYLKWINTGQIPCFEDGGHHRPNRHAEISRLIFRELEHICSKKDATPEE  339

SbPWD  LLVIRKIHPCLPSFKSEFTASVPLTRIRDIAHRNDIPHDLKQEIKHTIQNKLHRNAGPED  419
ZmPWD  ------------------------------------------------------------
AtPWD  VLVARKIHPCLPSFKAEFTAAVPLTRIRDIAHRNDIPHDLKQEIKHTIQNKLHRNAGPED  399

SbPWD  LIATEAMLARITKTPGEYSEAFVEQFKTFYSELKDFFNAGSLLEQVQSIEQSLDESGLEA  479
ZmPWD  ----------------------------------------LLEQLESIEQSLNESGLEA   19
AtPWD  LIATEAMLQRITETPGKYSGDFVEQFKIFHNELKDFFNAGSLTEQLDSMKISMDDRGLSA  459
                                               * **::*:: *::: **.*

SbPWD  LSSFLKTKKNLDQLEDAKDLDENGGVQVLLKTLLSLSYLRSILMKGLESGLRNDAPDSAI  539
ZmPWD  LSSFLKTKKNLDQLEDAKDLDENGGVHVLLKTLLSLSYLRSILMKGLESGLRNDAPDSAI   79
AtPWD  LNLFFECKKRLDTSG------ESSNVLELIKTMHSLASLRETIIKELNSGLRNDAPDTAI  513
       *. *:: **.**         *...* *:**: **: **. ::* *:*********:**

SbPWD  AMRQKWRLCEIGLEDYSFVLLSRYINALEALGGSASLAEGLPT-NTSLWDDALDALVIGI  598
ZmPWD  AMRQKWRLCEIGLEDYSFVLLSRYINALEALGGSASLAEGLPT-NTSLWDDALDALIIGI  138
AtPWD  AMRQKWRLCEIGLEDYFFVLLSRFLNALETMGGADQLAKDVGSRNVASWNDPLDALVLGV  573
       ****************  ******::****::**:  .**..:  *.: *:*.****::*:

SbPWD  NQVSFSGWKPNECTAIVNELLSWKQKGLSEFEGSEDGKYIWALRLKATLDRSRALTEEYS  658
ZmPWD  NQVCFSGWKPNECSAIVNELLSWKQKGLSEFEGNEDGKYIWALRLKATLDRTGRLTEEYS  198
```

```
                                       -continued
AtPWD  HQVGLSGWKQEECLAIGNELLAWRERDLLEKEGEEDGKTIWAMRLKATLDRARRLTAEYS   633
       :**  :****  :**  **  ****:*:  ::  *  *  **.****  ***:********:  ***  ***

SbPWD  EALLSIFPEKVKVLGKALGIPENSVRTYTEAEIRAGVIFQVSKLCTVLLKATRAVLGSSV    718
ZmPWD  EALLSIFPEKVKVLGKALGIPENSVRTYTEAEIRASVIFQVSKLCTVLLKATRAVLGSSV    258
AtPWD  DLLLQIFPPNVEILGKALGIPENSVKTYTEAEIRAGIIFQISKLCTVLLKAVRNSLGSEG    693
       :  **.***   :*:.:***********:*********.:***.:*********.*   ***.

SbPWD  WDVLVPGVAHGALIQVERIAPGSLPSSIKEPVVLVVNKADGDEEVKAAGDNIVGVILLQE    778
ZmPWD  WDVLVPGVAHGALIQVERIAPGSLPSSMKEPVVLVVNKADGDEEVKAAGDNIVGVVLLQE    318
AtPWD  WDVVVPGSTSGTLVQVESIVPGSLPATSGGPIILLVNKADGDEEVSAANGNIAGVMLLQE    753
       ***:***   :  *:*:***  *.*****.::     *::*:************.**..**.**:****

SbPWD  LPHLSHLGVRARQEKVVFVTCEDDDTIKNTRLLEGKYVRLGASSNNVDLSVVSNKDECAA    838
ZmPWD  LPHLSHLGVRARQEKVVFVTCEDDDTIKNMRLLEGKHVRLGASSNNVDLSVVSNKDDCAA    378
AtPWD  LPHLSHLGVRARQEKIVFVTCDDDDKVADIRRLVGKFVRLEASPSHVNLILST---EGRS    810
       ***************:*****:***.***.:  :  *  *  **.***  **..:*:*    :  :    :  :

SbPWD  MSSELSSGGNLFAQQFSLPLTTDKKLELSEQRS-----------YTSGANIMSGVLELSE    887
ZmPWD  MSSEPSAGGDLFAQQFSL-LTTDKKLELSEQKS-----------YTSVANGMSGVLELSE    426
AtPWD  RTSKSSATKKTDKNSLSKKKTDKKSLSIDDEESKPGSSSSNSLLYSSKDIPSGGIIALAD    870
       .:*:  *:  .     :.:*     *  .*.*.:..:.*          *:*          .*::  *::

SbPWD  ASIESSGAKAAACGTLSVLSSVSNKVYNDQGTPAAFRVPAGAVIPFGSMEDAFKKSGSLK    947
ZmPWD  ASIESSGAKAAACGTLSVLSSMSNKVYNDQGTPAAFRVPAGAVIPFGSMEDALKKSGSLK    486
AtPWD  ADVPTSGSKSAACGLLASLAEASSKVHSEHGVPASFKVPTGVVIPFGSMELALKQNNSEE    930
       *.:  :**:*:****  *:  *:.  *.**:..::*.**:*:**:*  ********  *:*::.*  :

SbPWD  SYTNLLERIETAQIENGELDSLSAELQATVSLLSPSEEIIESLKRIFDQNVRLIVRSTAN   1007
ZmPWD  SYTNLLERIETAQIENGELDSLSSKLQATVSLLSPSEEIIESLKKTFDQNVRLIVRSTAN    546
AtPWD  KFASLLEKLETARPEGGELDDICDQIHEVMKTLQVPKETINSISKAFLKDARLIVRSSAN    990
       .::.***:***:  *.****.:.   :::  .:. *.  ..:*  *:*:.:  *   ::.******:**

SbPWD  VEDLAGMSAAGLYESIPNVSLSDPSSFCAAVGQVWASLYTRRAILSRRAAGVPQRDAKMA   1067
ZmPWD  VEDLAGMSAAGLYESIPNVSLSDPRSFGAAVGQVWASLYTRRAILSRRAAGVPQRDAKMA    606
AtPWD  VEDLAGMSAAGLYESIPNVSPSDPLVFSDSVCQVWASLYTRRAVLSRRAAGVSQREASMA   1050
       ********************  ***   *    :*  ***********.*********.**:*.**

SbPWD  VLVQEMLQPDLSFVLHTVSPVDHDPKLVEAEVAPGLGETLASGTRGTPWRLSCHKFDGKV   1127
ZmPWD  VLVQEMLQPDLSFVLHTISPVDHDPKLVEAEVAPGLGETLASGTRGTPWRLSCHKLDGKV    666
AtPWD  VLVQEMLSPDLSFVLHTVSPADPDSNLVEAEIAPGLGETLASGTRGTPWRLASGKLDGIV   1110
       *******.*********:**.*  *.:*****:*********************:.  *:**  *

SbPWD  TTLAFANFSEEMVVLNSGPTDGEVTRRTVDYSKKPLSVDATFRGQFGQRLAAIGQYLEQK   1187
ZmPWD  TTLAFANFSEELMVLNSGPTDGEMSRRTVDYSKKPLSVDATFREQFGQRLAAIGQYLEQK    726
AtPWD  QTLAFANFSEELLVSGTGPADGKYVRLTVDYSKKRLTVDSVFRQQLGQRLGSVGFFLERN   1170
       **********.::*  .:**:**:  *  *******  *:**:.**  *:****.::.:*  :**::

SbPWD  FGSAQDVEGCLVGQDIFIVQSRPQP-   1212  (SEQ ID NO: 14)
ZmPWD  FGSAQDVEGCLVGPDIFIVQSRPQPQ   752   (SEQ ID NO: 15)
AtPWD  FGCAQDVEGCLVGEDVYIVQSRPQPL  1196  (SEQ ID NO: 16)
       **.**********  *:.:********
```

Based on this homology, it was possible to identify gene sequences (including coding sequences that had been previously unannotated in public databases) that correspond the PWD enzymes from the genomes of the respective species. These sequences include putative PWD cDNA (coding) sequences from sorghum (SEQ ID NO: 17), maize (SEQ ID NO: 18), and rice (SEQ ID NO: 19), and the corresponding genes from which the PWD mRNAs are transcribed for PWD from sorghum (SEQ ID NO: 20) and maize (SEQ ID NO: 21). Furthermore, from this information, one can also infer the sequences of the 5' untranslated regions (UTRs) and promoters of the PWD gene in sorghum (SEQ ID NO: 22), as well as the 3' UTRs of the respective PWD genes in sorghum (SEQ ID NO: 23) and maize (SEQ ID NO: 24). The 24.3 kb SbPWD gene is located on sorghum chromosome 4. The deduced protein sequence of the SbPWD (1212AA) has 57% sequence identity in its entire length to the functionally characterized *Arabidopsis* 1196AA PWD protein (AY747068). However, only the C-terminal part of the SbPWD protein (374AA) has sequence homology to maize genomic sequences localized on chromosome 10. This partial protein sequence of maize ZmPWD has 58% sequence identity to AtPWD and 93% sequence identity to SbPWD. Sequence alignment of the compiled sequences for the last 13 exons of the SbPWD and ZmPWD genes demonstrated 95.2% sequence identity on the nucleotide level between coding regions. However, when the entire genomic sequences for this part of the maize and sorghum PWD are aligned, only 31% sequence identity is present. The differences in intronic sequences between the two genes could explain this situation. For example, intron #11 in SbPWD is 5.3 kb and intron #13 is 0.8 kb, while their counterparts in ZmPWD are 17 kb and 5 kb long. The opposite situation was found for intron #16, which is 3.6 kb in SbPWD and only 248 bp in ZmPWD. Sequence analysis of the 252 bp 3' UTR of SbPWD and ZmPWD demonstrated 78% sequence identity interrupted by numerous breaks in homology.

CLUSTAL sequence alignment as follows was used to identify candidate DSP target proteins from maize (ZmDSP; SEQ ID NO: 25) and sorghum (SbDSP; SEQ ID NO: 26) based on their similarity to the known DSP protein from *Arabidopsis thaliana* (AtDSP; SEQ ID NO: 27). Similarly, it was possible to identify a candidate rice DSP protein (OsDSP; SEQ ID NO: 28) among lists of hypothetical proteins from rice.

```
CLUSTAL 2.1 multiple sequence alignment ZmDSP, SbDSP and AtDSP
ZmDSP  MNCLQNLLKE--PPIVGSRSMRR---PSPLNLAMVRGGSRRSNTVKT---LQAPGASTSG  52
SbDSP  MNCLQNLLKE--PPIVGSRSMRR---PSPLNLAMVRGGSRRSNTVKT---LQAPGASTSG  52
AtDSP  MNCLQNLPRCSVSPLLGFGCIQRDHSSSSSLKMLISPPIKANDPKSRLVLHAVSESKSS   60
       *******   . .*::*  .::*    .*. .* *:. . ..:*   *:    *:*  . *.*.

ZmDSP  AESSAVEMGTEKSEVYSTNMTQAMGAALTYRHELGMNYNFIRPDLIVGSCLQSPLDVDKL  112
SbDSP  AESSAVEMGTEKSEVYSTNMTHAMGAALTYRHELGMNYNFIRPDLIVGSCLQSPLDVDKL  112
AtDSP  SEMSGVAKDEEKSDEYSQDMTQAMGAVLTYRHELGMNYNFIRPDLIVGSCLQTPEDVDKL  120
       :* *.*  . ***: ** :**:****.***************************:* *****

ZmDSP  RKIGVKTVFCLQQDSDLEYFGVDIRAIQDYSLQFKDIVHCRAEIRDFDAFDLRLRLPAVV  172
SbDSP  RKIGVKTVFCLQQDSDLEYFGVDIGAIQDYSLQFKDIMHCRAEIRDFDAFDLRLRLPAVV  172
AtDSP  RKIGVKTIFCLQQDPDLEYFGVDISSIQAYAKKYSDIQHIRCEIRDFDAFDLRMRLPAVV  180
       *******:******.********* :** *:   ::.** * *.***********:******

ZmDSP  SKLHKLINCNGGVTYIHCTAGLGRAPAVALAYMFWILGYSLNEGHRLLQSKRACFPKLEA  232
SbDSP  SKLHKLVNCNGGVTYIHCTAGLGRAPAVALAYMFWILGYSLNEGHQLLQSKRACFPKLEA  232
AtDSP  GTLYKAVKRNGGVTYVHCTAGMGRAPAVALTYMFWVQGYKLMEAHKLLMSKRSCFPKLDA  240
       ..*:*  :: ******:***** :**********:****.:    **.*  *.*:** ***:*****.*

ZmDSP  IKLATADILTGLSKNTITLKWEADGSSSVEISGLDIGWGQRIPLTYDEEKGAWFLEKELP  292
SbDSP  IKLATADILTGLSKNTITLKWEDDGSSSVEISGLDIGWGQRIPLTYDEERGAWFLEKELP  292
AtDSP  IRNATIDILTGLKRKTVTLTLKDKGFSRVEISGLDIGWGQRIPLTLDKGTGFWILKRELP  300
       *: ** ******.::*:**.    :  .* * *****************  *:   * *:*:.***

ZmDSP  EGRYEYKYVVDGKWLCNEHELITKPNADGHVNNYVQVSRDGTSDEEKELRERLTGPDPDL  352
SbDSP  EGRYEYKYIVDGKWLCNEHEMLTKPNADGHVNNYVQVSRDGTSDEEKELRERLTGPDPVL  352
AtDSP  EGQFEYKYIIDGEWTHNEAEPFIGPNKDGHTNNYAKVVDDPTS-VDGTTRERLSSEDPEL  359
       **::****::**:*  ** * :  **.***.***.***.:*   * **    ****:. ** *

ZmDSP  TDQERLMIREYLEQYADAAER 373 (SEQ ID NO: 25)
SbDSP  TDEERLMIREYLEQYADAGER 373 (SEQ ID NO: 26)
AtDSP  LEEERSKLIQFLETCSEAEV- 379 (SEQ ID NO: 27)
       ::**    :  ::**   ::*
```

Based on this homology, it was possible to identify gene sequences (including coding sequences which had been previously unannotated in public databases) that correspond the DSP enzymes from the genomes of the respective species. These sequences include putative DSP cDNA (coding) sequences from maize (SEQ ID NO: 29), sorghum (SEQ ID NO: 30), and rice (SEQ ID NO: 31), the corresponding genes from which the DSP mRNAs are transcribed for DSP from maize (SEQ ID NO: 32) and sorghum (SEQ ID NO: 33). Furthermore, from this information, one can also infer the sequences of the 5' untranslated regions (UTRs) and promoters of the DSP gene in maize (SEQ ID NO: 34) and sorghum (SEQ ID NO: 35), as well as the 3' UTRs of the respective DSP genes in maize (SEQ ID NO: 36) and sorghum (SEQ ID NO: 37). The 5 kb and 6 kb DSP genes are localized on chromosomes 1 of sorghum and maize genomes, respectively. The DSP gene structure is very similar in both maize and sorghum, with each gene containing 14 exons of identical length and 13 slightly differently sized introns. The deduced protein sequence alignment between Arabidopsis, maize, and sorghum demonstrates 58.8% identity, while between SbDSP and ZmDSP proteins there is 96.5% sequence identity on the amino acid level. The sequence identity between the compiled exons of SbDSP and ZmDSP genes is 95.5%, while when the introns are included, the identity between the two genes drops to 65.3%. There is 50-60% sequence identity in 5'13' UTR regions. Both SbDSP and ZmDSP proteins contain the DSPc domain (Dual specificity phosphatase, catalytic domain) at 130-227AA with the active site at the residue C190.

Example 2

Suppressing Expression, Accumulation, or Activity of the Target Enzymes in Plants Once the genes encoding each of the target enzymes have been identified in a given species, the next objective was to suppress the expression, accumulation, or activity of that enzyme in planta.

The target genes were inhibited using an RNA interference strategy. One approach to gene suppression via RNA interference was to modify a naturally-occurring microRNA sequence such that its native targeting sequences are altered so that they will recognize a different target sequence, and then to express this modified microRNA according to Wartmann et al. 2008, which is incorporated herein by reference as if fully set forth.

Figure 3:
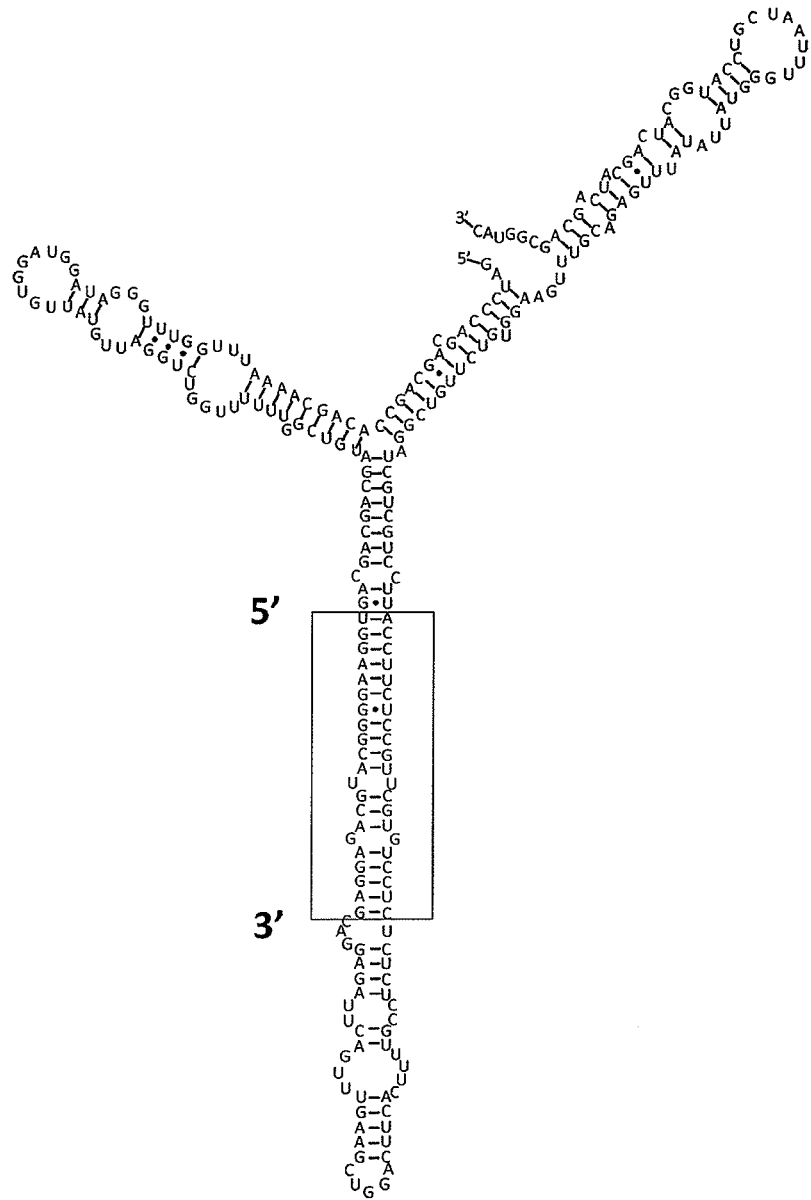
FIG. 3 illustrates a diagram of a naturally-occurring microRNA (osa-MIR528; SEQ ID NO: 159) from rice. Driver sequences are boxed and can be altered to change the targeting specificity of the microRNA (adapted from Wartmann et al. 2008).

An example of naturally occurring microRNA from rice is illustrated in FIG. 3. Nucleotide sequences of OsGWD amiRNA1wmd3 (SEQ ID NO: 38) and OsGWD osa-MIR809aM1 (SEQ ID NO: 39), such as shown in FIG. 3, that encode microRNAs targeting a messenger RNA encoding rice GWD protein were introduced into expression cassette for suppression of the expression of a target enzyme.

Alternatively, the expression of a target enzyme was suppressed by expressing an appropriately-designed hairpin RNA ("hpRNA") that includes inverted copies of an RNA sequence that is homologous to a portion of the mRNA, the 5' UTR, or the 3' UTR for a target enzyme, according to Horiguchi 2004, which is incorporated herein by reference as if fully set forth. The sequences homologous to the target mRNA are called "driver sequences." DNA sequences encoding individual RNA driver sequences that were used to create hpRNAs include OsDSP1 (SEQ ID NO: 40), OsDSP2 (SEQ ID NO: 41): OsGWD1 (SEQ ID NO: 42), OsGWD2 (SEQ ID NO: 43), OsPWD1 (SEQ ID NO: 44), OsPWD2 (SEQ ID NO: 45), SbGWD (SEQ ID NO: 46), SbGWD1 (SEQ ID NO: 47), SbGWD2 (SEQ ID NO: 48), ZmGWD1 (SEQ ID NO: 49) and ZmGWD2 (SEQ ID NO: 50).

The strategy for expressing inverted driver sequences was to transcribe them such that the inverted copies were separated by a spacer sequence. This spacer itself corresponded to an intron. Introns that were used included the Zea mays alcohol dehydrogenase intron (ZmAdh1i6; SEQ ID NO: 51), the *Oryza sativa* alcohol dehydrogenase intron (OsAdh1i; SEQ ID NO: 52), *Sorghum bicolor* alcohol dehydrogenase intron (SbAdh1-2i: SEQ ID NO: 53) and *Sorghum bicolor* glucan water dikinase intron (SbGWDi; SEQ ID NO: 54). In an expression cassette, to direct transcription of the microRNA or hpRNA a driver sequence was linked to the *Z. mays* ubiquitin promoter (ZmUbi1P; SEQ ID NO: 55), the *Z. mays* phosphoenolpyruvate carboxylase promoter (ZmPepCP: SEQ ID NO: 56) or the *O. sativa* ubiquitin promoter (OsUbi3P; SEQ ID NO: 57). A polyadenylation signal (NOS terminator; SEQ ID NO: 58) was used as the transcription terminator.

Figure 4:
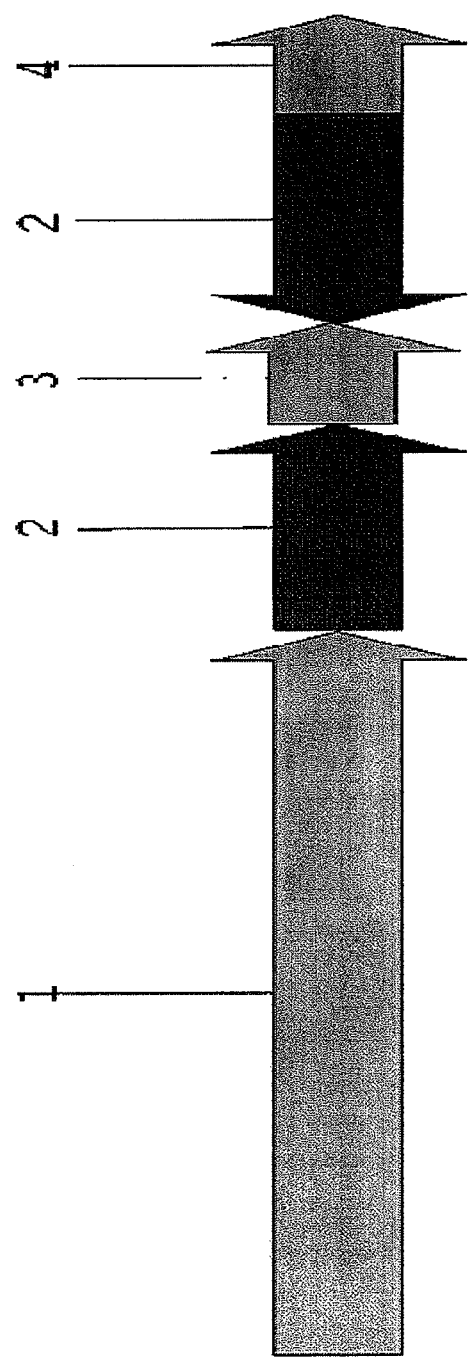
FIG. 4 illustrates a diagram of a synthetic gene for expressing a single hpRNA.

FIG. 4 illustrates a single expression cassette comprised of a synthetic gene that encodes one such hpRNA. This figure shows the expression cassette including (1) a promoter element, (2) a set of the driver sequences (black) positioned in opposite orientations such that the RNA transcript will be self-complementary in these regions, (3) an intron or a spacer element, and (4) a transcription terminator/polyadenylation signal. Examples of such expression cassettes include SEQ ID NO: 59 [OsUbi3P: OsGWD amiRNA1wmd3], SEQ ID NO: 60 [OsUbi3P: OsGWD osa-MIR809aM1], SEQ ID NO: 61 [OsUbi3P: OsDSP1hpRNA], SEQ ID NO: 62 [OsUbi3P:OsDSP2 hpRNA], SEQ ID NO: 63 [OsUbi3P:OsGWD1 hpRNA], SEQ ID NO: 64 [OsUbi3P: OsGWD2 hpRNA], SEQ ID NO: 65 [OsUbi3:OsPWD1 hpRNA], SEQ ID NO: 66 [Os-Ubi3:OsPWD2 hpRNA], SEQ ID NO: 67 [OsUbi3P:SbGWD RNAi], SEQ ID NO: 68 [ZmPepCP:SbGWD1 RNAi], SEQ ID NO: 69 [ZmPepCP:SbGWD2 RNAi], SEQ ID NO: 70 [ZmPepCP:ZmGWD1 RNAi] and SEQ ID NO: 71 [ZmPepCP:ZmGWD2 RNAi].

Figure 5:
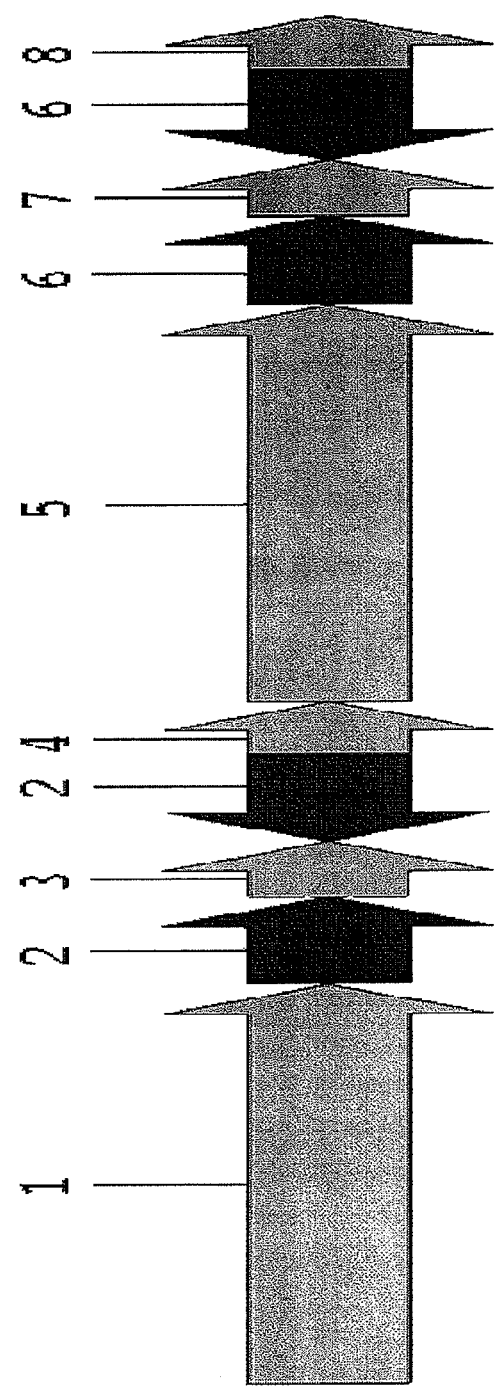
FIG. 5 illustrates a genetic construct that includes expression cassettes for two hpRNAs.

Multiple cassettes for different hpRNAs can be linked in a single construct to be introduced into transgenic plants such that two hpRNAs will be expressed simultaneously. FIG. 5 illustrates one example of such a construct. This figure shows (1) first promoter element, (2) a first set of driver sequences (black) positioned in opposite orientations such that the RNA transcript will be complementary in these regions, (3) a first intron or a spacer element, (4) a first transcription terminator/polyadenylation signal, (5) a second promoter element; (6) a second set of driver sequences (black), (7) a second intron or a spacer element, and (8) a second transcription terminator/polyadenylation signal.

Examples of constructs with multiple hpRNA expression cassettes are provided as SEQ ID NO: 72 [OsDSP1 and OsGWD2], SEQ ID NO: 73[OsPWD2 and OsGWD1] and SEQ ID NO: 74 [OsDSP2 and OsPWD1].

Example 3

Vectors

Sequences from any gene related to starch regulation may be provided in an intermediate RNAi vector, a transformation vector, or in a transgenic plant herein.

RNAi Vector pAL409

An example of an intermediate RNAi vector is pAL409, which is illustrated in FIG. 2. As shown in FIG. 2, inverted copies of segments from a transcribed region from a gene to be targeted can be introduced into pAL409 at the AvrII site 220 (position 4507) and the BspEI site 210 (position 4519), and again at the AgeI site 295 (position 566) and the NheI site 290 (position 620). When transcribed from the rice ubiquitin promoter 230 (P-OsUbi3), the inverted copies of the segments (the driver sequences) allow the resulting RNA to form a hairpin in which the OsUbi3 intron 200 serves as a spacer between the repeated elements. A polyadenylation signal 280 (NOS 3') serves as the transcriptional terminator. The entire expression cassette (from the promoter through the terminator) can be excised from this plasmid as a PacI-XmaI fragment by digesting at the PacI site 240 (position 3574) and the XmaI site 270 (position 911). pAL409 also includes a ColEI, *E. coli* origin of replication 260; and a bla 250 ampicillin resistance marker. The sequence of pAL409 is provided below, but nucleotide numbering and orientation differ from that depicted in FIG. 2. The skilled artisan will be able to align the sequence below with the vector map of FIG. 2 given the landmarks of the vector. An intermediate RNAi vector such as pAL409 can be used to introduce tandem, inverted copies of virtually any driver sequences.

>pAL409 sequence

[SEQ ID NO: 185]

```
TCGCGCGTTTCGGTGATGACGGTGAAAACCTCTGACACATGCAGCTCCC
GGAGACGGTCACAGCTTGTCTGTAAGCGGATGCCGGGAGCAGACAAGCC
CGTCAGGGCGCGTCAGCGGGTGTTGGCGGGTGTCGGGGCTGGCTTAACT
ATGCGGCATCAGAGCAGATTGTACTGAGAGTGCACCATATGCGGTGTGA
AATACCGCACAGATGCGTAAGGAGAAAATACCGCATCAGGCGCCATTCG
CCATTCAGGCTGCGCAACTGTTGGGAAGGGCGATCGGTGCGGGCCTCTT
CGCTATTACGCCAGCTGGCGAAAGGGGATGTGCTGCAAGGCGATTAAG
TTGGGTAACGCCAGGGTTTTCCCAGTCACGACGTTGTAAAACGACGGCC
AGTGAATTCGGGCGGTTAATTAACTAATCGACTCTAGTAACGGCCGCCA
GTGTGCTGGAATTAATTCGGCTTGTCGACCACCCAACCCCATATCGACA
GAGGATGTGAAGAACAGGTAAATCACGCAGAAGAACCCATCTCTGATAG
CAGCTATCGATTAGAACAACGAATCCATATTGGGTCCGTGGGAAATACT
TACTGCACAGGAAGGGGCGATCTGACGAGGCCCCGCCACCGGCCTCGA
CCCGAGGCCGAGGCCGACGAAGCGCCGGCGAGTACGGCGCCGCGGCGGC
CTCTGCCCGTGCCCTCTGCGCGTGGGAGGGAGAGGCCGCGGTGGTGGGG
GCGCGCGCGCGCGCGCGCGCAGCTGGTGCGGCGGCGCGGGGGTCAGCCG
CCGAGCCGGCGGCGACGGAGGAGCAGGGCGGCGTGGACGCGAACTTCCG
ATCGGTTGGTCAGAGTGCGCGAGTTGGGCTTAGCCAATTAGGTCTCAAC
AATCTATTGGGCCGTAAAATTCATGGGCCCTGGTTTGTCTAGGCCCAAT
ATCCCGTTCATTTCAGCCCACAAATATTTCCCCAGAGGATTATTAAGGC
CCACACGCAGCTTATAGCAGATCAAGTACGATGTTTCCTGATCGTTGGA
TCGGAAACGTACGGTCTTGATCAGGCATGCCGACTTCGTCAAAGAGAGG
CGGCATGACCTGACGCGGAGTTGGTTCCGGGCACCGTCTGGATGGTCGT
ACCGGGACCGGACACGTGTCGCGCCTCCAACTACATGGACACGTGTGGT
GCTGCCATTGGGCCGTACGCGTGGCGGTGACCGCACCGGATGCTGCCTC
GCACCGCCTTGCCCACGCTTTATATAGAGAGGTTTTCTCTCCATTAATC
GCATAGCGAGTCGAATCGACCGAAGGGGAGGGGGAGCGAGAGCTTTGCG
TTCTCTAATCGCCTCGTCAAGCCTAGGTGTGTGTCCGGAGTCAAGGTAA
CTAATCAATCACCTCGTCCTAATCCTCGAATCTCTCGTGGTGCCCGTCT
AATCTCGCGATTTTGATGCTCGTGGTGGAAAGCGTAGGAGGATCCCGTG
```

-continued

```
CGAGTTAGTCTCAATCTCTCAGGGTTTCGTGCGATTTTAGGGTGATCCA

CCTCTTAATCGAGTTACGGTTTCGTGCGATTTTAGGGTAATCCTCTTAA

TCTCTCATTGATTTAGGGTTTCGTGAGAATCGAGGTAGGGATCTGTGTT

ATTTATATCGATCTAATAGATGGATTGGTTTTGAGATTGTTCTGTCAGA

TGGGGATTGTTTCGATATATTACCCTAATGATGTGTCAGATGGGGATTG

TTTCGATATATTACCCTAATGATGTGTCAGATGGGGATTGTTTCGATAT

ATTACCCTAATGATGGATAATAAGAGTAGTTCACAGTTATGTTTTGATC

CTGCCACATAGTTTGAGTTTTGTGATCAGATTTAGTTTTACTTATTTGT

GCTTAGTTCGGATGGGATTGTTCTGATATTGTTCCAATAGATGAATAGC

TCGTTAGGTTAAAATCTTTAGGTTGAGTTAGGCGACACATAGTTTATTT

CCTCTGGATTTGGATTGGAATTGTGTTCTTAGTTTTTTTCCCCTGGATT

TGGATTGGAATTGTGTGGAGCTGGGTTAGAGAATTACATCTGTATCGTG

TACACCTACTTGAACTGTAGAGCTTGGGTTCTAAGGTCAATTTAATCTG

TATTGTATCGGCTCTTTGCCTAGTTGAACTGTAGTGCTGATGTTGTAC

TGTGTTTTTTTACCCGTTTTATTTGCTTTACTCGTGCAAATCAAATCTG

TCAGATGCTAGAACTAGGTGGCTTTATTCTGTGTTCTTACATAGATCTG

TTGTCCTGTAGTTACTTATGTCAGTTTTGTTATTATCTGAAGATATTTT

TGGTTGTTGCTTGTTGATGTGGTGAGCTGTGAGCAGCGCTCTTATGA

TTAATGATGCTGTCCAATTGTAGTGTAGTATGATGTGATTGATATGTTC

ATCTATTTTGAGCTGACAGTACCGATATCGTAGGATCTGGTGCCAACTT

ATTCTCCAGCTGCTTTTTTTTACCTATGTTAATTCCAATCCTTTCTTGC

CTCTTCCAGGGATCCACCGGTCCGATCGAGCTTACTGAAAAAATTAACA

TCTCTTGCTAAGCTGGGAGCGCTAGCTCCCCGAATTTCCCCGATCGTTC

AAACATTTGGCAATAAAGTTTCTTAAGATTGAATCCTGTTGCCGGTCTT

GCGATGATTATCATATAATTTCTGTTGAATTACGTTAAGCATGTAATAA

TTAACATGTAATGCATGACGTTATTTATGAGATGGGTTTTTATGATTAG

AGTCCCGCAATTATACATTTAATACGCGATAGAAAACAAATATAGCGC

GCAAACTAGGATAAATTATCGCGCGCGGTGTCATCTATGTTACTAGATC

GGGAATTGGCGAGCTCGCCCGGCGGGCGAAGCTTGGCGTAATCATGGT

CATAGCTGTTTCCTGTGTGAAATTGTTATCCGCTCACAATTCCACACAA

CATACGAGCCGGAAGCATAAAGTGTAAAGCCTGGGGTGCCTAATGAGTG

AGCTAACTCACATTAATTGCGTTGCGCTCACTGCCCGCTTTCCAGTCGG

GAAACCTGTCGTGCCAGCTGCATTAATGAATCGGCCAACGCGCGGGAG

AGGCGGTTTGCGTATTGGGCGCTCTTCCGCTTCCTCGCTCACTGACTCG

CTGCGCTCGGTCGTTCGGCTGCGGCGAGCGGTATCAGCTCACTCAAAGG

CGGTAATACGGTTATCCACAGAATCAGGGGATAACGCAGGAAAGAACAT

GTGAGCAAAAGGCCAGCAAAAGGCCAGGAACCGTAAAAAGGCCGCGTTG

CTGGCGTTTTTCCATAGGCTCCGCCCCCCTGACGAGCATCACAAAAATC

GACGCTCAAGTCAGAGGTGGCGAAACCCGACAGGACTATAAAGATACCA

GGCGTTTCCCCCTGGAAGCTCCCTCGTGCGCTCTCCTGTTCCGACCCTG

CCGCTTACCGGATACCTGTCCGCCTTTCTCCCTTCGGGAAGCGTGGCGC

TTTCTCATAGCTCACGCTGTAGGTATCTCAGTTCGGTGTAGGTCGTTCG

CTCCAAGCTGGGCTGTGTGCACGAACCCCCCGTTCAGCCCGACCGCTGC

GCCTTATCCGGTAACTATCGTCTTGAGTCCAACCCGGTAAGACACGACT

TATCGCCACTGGCAGCAGCCACTGGTAACAGGATTAGCAGAGCGAGGTA

TGTAGGCGGTGCTACAGAGTTCTTGAAGTGGTGGCCTAACTACGGCTAC

ACTAGAAGGACAGTATTTGGTATCTGCGCTCTGCTGAAGCCAGTTACCT

TCGGAAAAAGAGTTGGTAGCTCTTGATCCGGCAAACAAACCACCGCTGG

TAGCGGTGGTTTTTTTGTTTGCAAGCAGCAGATTACGCGCAGAAAAAAA

GGATCTCAAGAAGATCCTTTGATCTTTTCTACGGGGTCTGACGCTCAGT

GGAACGAAAACTCACGTTAAGGGATTTTGGTCATGAGATTATCAAAAAG

GATCTTCACCTAGATCCTTTTAAATTAAAAATGAAGTTTTAAATCAATC

TAAAGTATATATGAGTAAACTTGGTCTGACAGTTACCAATGCTTAATCA

GTGAGGCACCTATCTCAGCGATCTGTCTATTTCGTTCATCCATAGTTGC

CTGACTCCCCGTCGTGTAGATAACTACGATACGGGAGGGCTTACCATCT

GGCCCCAGTGCTGCAATGATACCGCGAGACCCACGCTCACCGGCTCCAG

ATTTATCAGCAATAAACCAGCCAGCCGGAAGGGCCGAGCGCAGAAGTGG

TCCTGCAACTTTATCCGCCTCCATCCAGTCTATTAATTGTTGCCGGGAA

GCTAGAGTAAGTAGTTCGCCAGTTAATAGTTTGCGCAACGTTGTTGCCA

TTGCTACAGGCATCGTGGTGTCACGCTCGTCGTTTGGTATGGCTTCATT

CAGCTCCGGTTCCCAACGATCAAGGCGAGTTACATGATCCCCCATGTTG

TGCAAAAAAGCGGTTAGCTCCTTCGGTCCTCCGATCGTTGTCAGAAGTA

AGTTGGCCGCAGTGTTATCACTCATGGTTATGGCAGCACTGCATAATTC

TCTTACTGTCATGCCATCCGTAAGATGCTTTTCTGTGACTGGTGAGTAC

TCAACCAAGTCATTCTGAGAATAGTGTATGCGGCGACCGAGTTGCTCTT

GCCCGGCGTCAATACGGGATAATACCGCGCCACATAGCAGAACTTTAAA

AGTGCTCATCATTGGAAAACGTTCTTCGGGGCGAAAACTCTCAAGGATC

TTACCGCTGTTGAGATCCAGTTCGATGTAACCCACTCGTGCACCCAACT

GATCTTCAGCATCTTTTACTTTCACCAGCGTTTCTGGGTGAGCAAAAAC

AGGAAGGCAAAATGCCGCAAAAAAGGGAATAAGGGCGACACGGAAATGT

TGAATACTCATACTCTTCCTTTTTCAATATTATTGAAGCATTTATCAGG

GTTATTGTCTCATGAGCGGATACATATTTGAATGTATTTAGAAAAATAA

ACAAATAGGGGTTCCGCGCACATTTCCCCGAAAAGTGCCACCTGACGTC

TAAGAAACCATTATTATCATGACATTAACCTATAAAAATAGGCGTATCA

CGAGGCCCTTTCGTC
```

Embodiments herein provide intermediate RNAi vectors that replicate to high copy in *E. coli*, have low complexity, and several convenient restriction sites. pAL409 has these characteristics. Vectors with such characteristics would be useful for assembling RNAi expression cassettes that can then be transferred to an *Agrobacterium* transformation vector.

Transformation Vectors

Figure 6:
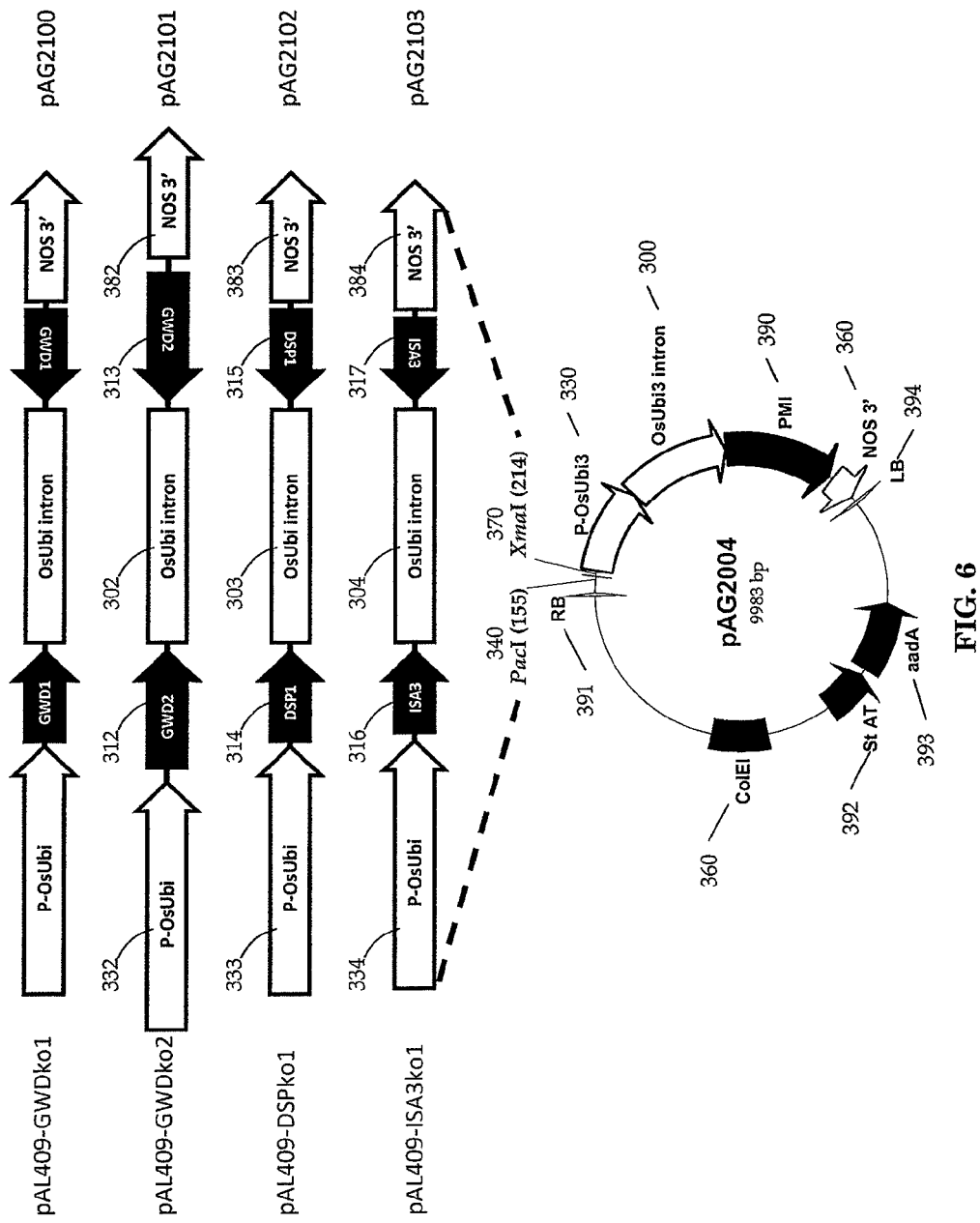
FIG. 6 illustrates RNAi cassettes targeting rice GWD, DSP, and ISA3 genes.

An exemplary transformation vector, pAG2004 is illustrated in FIG. 6. pAG2004 [SEQ ID NO:186]. pAG2004 includes a rice ubiquitin intron 300 (OsUbi3 intron), a rice ubiquitin promoter 330 (P-OsUbi3), a PadI site 340 (position 155), an XmaI site 370 (position 214), a NOS 3' polyadenylation signal 380, and a ColEI *E. coli* origin of replication 360. pAG2004 also includes a phosphomannose isomerase (PMI) gene 390, an RB 391, an st AT 392 and an aadA 393. pAG2004 or similar vectors can be transferred from *E. coli* to *Agrobacterium tumefaciens* LBA4404 via conjugal transfer, during which the plasmid will integrate into pSB1 (a resident Ti plasmid) via homologous recombination. Co-culture of the resulting recombinant *Agrobacterium* strain with plant cells can result in the transfer of the pAG2004-derived DNA to the plant genome. Embodiments herein include a transformation vector having any driver sequences related to targets for alteration of Green Starch. Embodiments herein include a transformation vector having a fragment from pAL409 including driver sequences related to targets for alteration of Green Starch. Embodiments herein include a transformation vector having a PacI-XmaI fragment from pAL409 including driver sequences related to targets for alteration of Green Starch in place of the pAG2004 PacI-XmaI fragment.

Plant transformation vectors were assembled by inserting the expression cassettes or constructs described herein between the *Agrobacterium* T-DNA right border and left border sequences of a suitable plasmid such as pAG2005 or pAG4003 described below. Following are descriptions of several pAG2005, pAG4003 and derivative recombinant plasmid vectors that can be used to generate transgenic plants via *Agrobacterium*-mediated transformation:

pAG2005 (SEQ ID NO: 75) is a plasmid that carries a spectinomycin resistance marker, a bacterial origin of replication, an *Agrobacterium* T-DNA right border (RB), and an *Agrobacterium* T-DNA left border (LB). Between the RB and LB is a multicloning site (MCS) and a plant selectable marker comprised of a rice Ubi3 promoter (OsUbi3P), the phosphomannose isomerase coding sequence, and NOS terminator; this plasmid also carries an added rice Ubi3 promoter (OsUbi3P) and NOS terminator in the MCS, between which additional coding sequences, microRNA, or hpRNA transcription units may be added.

pAG2107 is pAG2005 with an OsGWD amiRNA1wmd3 microRNA (SEQ ID NO: 38) between the rice Ubi3 promoter (OsUbi3P) and NOS terminator.

pAG2108 is pAG2005 with an OsGWD osa-MIR809aM1 microRNA (SEQ ID NO: 39) between the rice Ubi3 promoter (OsUbi3P) and NOS terminator.

pAG2109 is pAG2005 with an OsDSP1 hpRNA silencing cassette-1 (SEQ ID NO: 40) between the rice Ubi3 promoter (OsUbi3P) and NOS terminator.

pAG2110 is pAG2005 with an OsGWD1 hpRNA silencing cassette-1 (SEQ ID NO: 42) between the rice Ubi3 promoter (OsUbi3P) and NOS terminator.

pAG2111 is pAG2005 with an OsGWD2 hpRNA silencing cassette-2 (SEQ ID NO: 43) between the rice Ubi3 promoter (OsUbi3P) and NOS terminator.

pAG2112 is pAG2005 with an OsPWD2 hpRNA silencing cassette-2 (SEQ ID NO: 45) between the rice Ubi3 promoter (OsUbi3P) and NOS terminator.

pAG2113 is pAG2005 with an OsDSP2 hpRNA silencing cassette-2 (SEQ ID NO: 41) between the rice Ubi3 promoter (OsUbi3P) and NOS terminator.

pAG2114 is pAG2005 with an OsPWD1 hpRNA silencing cassette-1 (SEQ ID NO: 44) between the rice Ubi3 promoter (OsUbi3P) and NOS terminator.

pAG2115 is pAG2111 with an additional OsDSP1 hpRNA silencing cassette-1; the tandem cassettes for expressing OsGWD2 and OsDSP1 hpRNAs is provided as SEQ ID NO: 72.

pAG2116 is pAG2110 with an additional OsPWD2 hpRNA silencing cassette-2; the tandem cassettes for expressing OsGWD1 and OsPWD2 hpRNAs is provided as SEQ ID NO: 73.

pAG2117 is pAG2114 with an additional OsDSP2 hpRNA silencing cassette-2; the tandem cassettes for expressing OsPWD1 and OsDSP2 hpRNAs is provided as SEQ ID NO: 74;

pAG4003 (SEQ ID NO: 76) is a plasmid that carries a spectinomycin resistance marker, a bacterial origin of replication, an *Agrobacterium* T-DNA right border (RB), and an *Agrobacterium* T-DNA left border (LB). Between the RB and LB is a multicloning site (MCS) and a plant selectable marker comprised of a maize ubiquitin promoter (ZmUbi1P), the phosphomannose isomerase coding sequence, and NOS terminator.

pAG4101 is pAG4003 with an SbGWD RNAi between the rice Ubi3 promoter (OsUbi3P) and NOS terminator (SEQ ID NO: 67).

pAG4102 is pAG4003 with an ZmGWD1 RNAi between the maize ZmPepC promoter (ZmPepCP) and NOS terminator (SEQ ID NO: 70).

pAG4103 is pAG4003 with an ZmGWD2 RNAi between the maize ZmPepC promoter and NOS terminator (SEQ ID NO: 71).

pAG4104 is pAG4003 with an SbGWD1 RNAi between the maize ZmPepC promoter and NOS terminator (SEQ ID NO: 68).

pAG4105 is pAG4003 with an SbGWD2 RNAi between the maize ZmPepC promoter and NOS terminator (SEQ ID NO: 69).

Sequences of the target proteins, genes, elements of the expression cassettes and vectors used herein are listed in Table 1.

TABLE 1

Description of Sequences.

| SEQ ID NO | Sequence Name | Sequence Description |
|---|---|---|
| 1 | SbGWD protein | amino acid sequence of hypothetical protein from Genbank accession XM_002438374 |
| 2 | ZmGWD protein | amino acid sequence of GWD target protein from maize |
| 3 | OsGWD protein | amino acid sequence of GWD target protein from rice |
| 4 | StGWD protein | amino acid sequence of GWD target protein from potato |
| 5 | SbGWD coding Sequence | nucleotide sequence encoding hypothetical protein from Genbank accession XM_002438374 |
| 6 | ZmGWD coding sequence | nucleotide sequence (cDNA) encoding unannotated protein from maizegdb.org accession GRMZM2G412611 |
| 7 | OsGWD coding sequence | nucleotide sequence encoding GWD target protein from rice |
| 8 | SbGWD gene | genomic sequence containing unannotated GWD-like sequence at plantgdb.org/Sb-GDB (37970015-37957888) |

TABLE 1-continued

Description of Sequences.

| SEQ ID NO | Sequence Name | Sequence Description |
|---|---|---|
| 9 | ZmGWD gene | genomic sequence containing unannotated GWD-like sequence GRMZM2G412611 at maizegdb.org (110695290-110706982) |
| 10 | SbGWD gene 5'UTR and promoter | genomic sequence upstream of GWD-like sequence at plantgdb.org/SbGDB (37973102-37970016) |
| 11 | ZmGWD gene 5'UTR and promoter | genomic sequence upstream of GWD-like sequence GRMZM2G412611 at maizegdb.org (110692290-110695289) |
| 12 | SbGWD gene 3'UTR | genomic sequence downstream of GWD-like sequence at plantgdb.org/SbGDB (37957887-37956500) |
| 13 | ZmGWD gene 3'UTR | genomic sequence downstream of GWD-like sequence GRMZM2G412611 at maizegdb.org (110706983-110708982) |
| 14 | SbPWD protein | amino acid sequence of possible PWD target protein from *sorghum* |
| 15 | ZmPWD protein | partial amino acid sequence of possible PWD target protein from maize |
| 16 | AtPWD protein | amino acid sequence of functionally characterized PWD protein from *Arabidopsis* (Genebank accession AY747068) |
| 17 | SbPWD coding sequence | nucleotide sequence (cDNA) encoding hypothetical protein from Genbank accession XM_002453614 |
| 18 | ZmPWD coding sequence | nucleotide sequence (cDNA) encoding PWD-like protein compiled from genomic sequence on maize Chromosome 10 (20383422-20409795) |
| 19 | OsPWD coding sequence | nucleotide sequence (cDNA) encoding PWD-like protein compiled from genomic sequence from rice |
| 20 | SbPWD gene | SbPWD gene genomic sequence containing unannotated PWD-like sequence at plantgdb.org/SbGDB (13092874-13068592) |
| 21 | ZmPWD gene | ZmPWD gene genomic sequence containing unannotated partial PWD-like sequence at maizegdb.org (20383406-20409795) |
| 22 | SbPWD gene 5'UTR and promoter | SbPWD gene 5'UTR and promoter genomic sequence upstream of PWD-like sequence at plantgdb.org/SbGDB (13095874-13092875) |
| 23 | SbPWD gene 3'UTR | SbPWD gene 3'UTR genomic sequence downstream of PWD-like sequence at plantgdb.org/SbGDB (13068591-13066592) |
| 24 | ZmPWD gene 3'UTR | ZmPWD gene 3'UTR genomic sequence downstream of PWD-like sequence at maizegdb.org (20409796-20411795) |
| 25 | ZmDSP protein | ZmDSP putative protein amino acid sequence of target protein from maize |
| 26 | SbDSP protein | SbDSP putative protein amino acid sequence of target protein from *sorghum* |
| 27 | AtDSP protein | AtDSP protein amino acid sequence of functionally characterized DSP protein from *Arabidopsis* (Genebank accession Q9FEB5) |
| 28 | OsDSP protein | OsDSP putative protein tyrosine phosphatase from rice, Genebank accession ABF93554.1 |
| 29 | ZmDSP coding sequence | nucleotide sequence (cDNA) encoding uncharacterized protein LOC100216768 from Genbank accession NM_001143167 |
| 30 | SbDSP coding sequence | nucleotide sequence (cDNA) encoding unannotated DSP-like sequence at plantgdb.org/SbGDB (73074312-73079318) |
| 31 | OsDSP coding sequence | nucleotide sequence (cDNA) encoding DSP-like protein compiled from genomic sequence from rice |
| 32 | ZmDSP gene | ZmDSP gene genomic sequence at maizegdb.org (2544510-2538556) containing uncharacterized protein LOC100216768 from Genbank accession NM_001143167 |
| 33 | SbDSP gene | SbDSP gene genomic sequence containing unannotated DSP-like sequence at plantgdb.org/SbGDB (73074312-73079318) |
| 34 | ZmDSP gene 5'UTR and promoter | ZmDSP gene 5'UTR and promoter genomic sequence at maizegdb.org (2538555-2536556) upstream of uncharacterized protein LOC100216768 from Genbank accession NM_001143167 |
| 35 | SbDSP gene 5'UTR and promoter | SbDSP gene 5'UTR and promoter genomic sequence upstream of unannotated DSP-like sequence at plantgdb.org/SbGDB (73071312-73074311) |
| 36 | ZmDSP gene 3'UTR | ZmDSP gene 3'UTR genomic sequence at maizegdb.org (2538555-2536556) downstream of uncharacterized protein LOC100216768 from Genbank accession NM_001143167 |
| 37 | SbDSP gene 3'UTR | SbDSP gene 3'UTR genomic sequence downstream of unannotated DSP-like sequence at plantgdb.org/SbGDB (73079319-73081318) |
| 38 | OsGWD amiRNA1wmd3 | DNA sequence encoding the OsGWD amiRNA1wmd3 micro RNA |
| 39 | OsGWD osa-MIR809aM1 | DNA sequence encoding the OsGWD osa-MIR809aM1 micro RNA |
| 40 | OsDSP1 | OsDSP1 hairpin RNA driver sequence |
| 41 | OsDSP2 | OsDSP2 hairpin RNA driver sequence |
| 42 | OsGWD1 | OsGWD1 hairpin RNA driver sequence |
| 43 | OsGWD2 | OsGWD2 hairpin RNA driver sequence |
| 44 | OsPWD1 | OsPWD1 hairpin RNA driver sequence |
| 45 | OsPWD2 | OsPWD2 hairpin RNA driver sequence |
| 46 | SbGWD | SbGWD hairpin RNA driver sequence |
| 47 | SbGWD1 | SbGWD1 hairpin RNA driver sequence |
| 48 | SbGWD2 | SbGWD2 hairpin RNA driver sequence |
| 49 | ZmGWD1 | ZmGWD1 hairpin RNA driver sequence |
| 50 | ZmGWD2 | ZmGWD2 hairpin RNA driver sequence |
| 51 | ZmAdh1i6 | DNA sequence corresponding to the ZmAdh1i6 intron |
| 52 | OsAdh1i | DNA sequence corresponding to the OsAdh1 intron |
| 53 | SbAdh1-2i | DNA sequence corresponding to the SbAdh1-2i intron |
| 54 | SbGWDi | DNA sequence corresponding to the SbGWDi intron |
| 55 | ZmUbi1P | maize Ubi1 promoter with intron |
| 56 | ZmPepCP | ZmPepC promoter |
| 57 | OsUbi3P | rice Ubi3 promoter with intron |
| 58 | NOS terminator | NOS transcriptional terminator and polyadenylation signal |
| 59 | OsUbi3P:OsGWD amiRNA1wmd3 | OsUbi3P:OsGWD amiRNA1wmd3 expression cassette for one micro RNA |
| 60 | OsUbi3P:OsGWD osa-MIR809aM1 | OsUbi3P:OsGWD osa-MIR809aM1 expression cassette for one micro RNA |
| 61 | OsUbi3P:OsDSP1 hpRNA | OsUbi3P:OsDSP1 hpRNA expression cassette for one hairpin RNA |
| 62 | OsUbi3P:OsDSP2 hpRNA | OsUbi3P:OsDSP2 hpRNA expression cassette for one hairpin RNA |
| 63 | OsUbi3P:OsGWD1 hpRNA | OsUbi3P:OsGWD1 hpRNA expression cassette for one hairpin RNA |
| 64 | OsUbi3P:OsGWD2 hpRNA | OsUbi3P:OsGWD2 hpRNA expression cassette for one hairpin RNA |
| 65 | OsUbi3P:OsPWD1 hpRNA | OsUbi3P:OsPWD1 hpRNA expression cassette for one hairpin RNA |
| 66 | OsUbi3P:OsPWD2 hpRNA | OsUbi3P:OsPWD2 hpRNA expression cassette for one hairpin RNA |
| 67 | OsUbi3P:SbGWD RNAi | OsUbi3P:SbGWD RNAi expression cassette for one hairpin RNA |
| 68 | ZmPepCP:SbGWD1 RNAi | ZmPepCP:SbGWD1 RNAi expression cassette for one hairpin RNA |

TABLE 1-continued

Description of Sequences.

| SEQ ID NO | Sequence Name | Sequence Description |
|---|---|---|
| 69 | ZmPepCP:SbGWD2 RNAi | ZmPepCP:SbGWD2 RNAi expression cassette for one hairpin RNA |
| 70 | ZmPepCP:ZmGWD1 RNAi | ZmPepCP:ZmGWD1 RNAi expression cassette for one hairpin RNA |
| 71 | ZmPepCP:ZmGWD2 RNAi | ZmPepCP:ZmGWD2 RNAi expression cassette for one hairpin RNA |
| 72 | OsDSP1 and OsGWD2 | OsDSP1 and OsGWD2 construct containing two hpRNA expression cassettes |
| 73 | OsPWD2 and OsGWD1 | OsPWD2 and OsGWD1 construct containing two hpRNA expression cassettes |
| 74 | OsDSP2 and OsPWD1 | OsDSP2 and OsPWD1 construct containing two hpRNA expression cassettes |
| 75 | pAG2005 | pAG2005 transformation vector with phsophomannose isomerase plant selectable marker |
| 76 | pAG4003 | pAG4003 transformation vector with phsophomannose isomerase plant selectable marker |
| 77 | O43097 protein | O43097 enzyme amino acid sequence |
| 78 | BD22308 protein | BD22308 enzyme amino acid sequence |
| 79 | BD25243 protein | BD25243 enzyme amino acid sequence |
| 80 | EU591743 protein | EU591743 enzyme amino acid sequence |
| 81 | NtEGm protein | NtEGm enzyme amino acid sequence |
| 82 | P0C2S1 protein | P0C2S1 enzyme amino acid sequence |
| 83 | P77853 protein | P77853 enzyme amino acid sequence |
| 84 | O68438 protein | O68438 enzyme amino acid sequence |
| 85 | O33897 protein | O33897 enzyme amino acid sequence |
| 86 | O43097 coding sequence | O43097 enzyme coding sequence |
| 87 | BD22308 coding sequence | BD22308 enzyme coding sequence |
| 88 | BD25243 coding sequence | BD25243 enzyme coding sequence |
| 89 | EU591743 coding sequence | EU591743 enzyme coding sequence |
| 90 | NtEGm coding sequence | NtEGm enzyme coding sequence |
| 91 | P0C2S1 coding sequence | P0C2S1 enzyme coding sequence |
| 92 | P77853 coding sequence | P77853 enzyme coding sequence |
| 93 | O68438 coding sequence | O68438 enzyme coding sequence |
| 94 | O33897 coding sequence | O33897 enzyme coding sequence |
| 95 | AS146-7 intein polypeptide | AS146-7 intein amino acid sequence |
| 96 | S158-30-108-35 intein polypeptide | S158-30-108-35 intein amino acid sequence |
| 97 | T134-100-101 intein polypeptide | T134-100-101 intein amino acid sequence |
| 98 | AS146-7 coding sequence | AS146-7 DNA sequence encoding an intein |
| 99 | S158-30-108-35 coding sequence | S158-30-108-35 DNA sequence encoding an intein |
| 100 | T134-100-101 coding sequence | T134-100-101 DNA sequence encoding an intein |
| 101 | EU591743:AS146-7 intein modified enzyme | EU591743:AS146-7 intein-modified enzyme amino acid sequence |
| 102 | P77853:S158-30-108-35 intein modified enzyme | P77853:S158-30-108-35 intein-modified enzyme amino acid sequence |
| 103 | P77853:T134-100-101 intein modified enzyme | P77853:T134-100-101 intein-modified enzyme amino acid sequence |
| 104 | EU591743:AS146-7 coding sequence | EU591743:AS146-7 intein-modified enzyme coding sequence |
| 105 | P77853:S158-30-108-35 coding sequence | P77853:S158-30-108-35 intein-modified enzyme coding sequence |
| 106 | P77853:T134-100-101 coding sequence | P77853:T134-100-101 intein-modified enzyme coding sequence |
| 107 | BAASS signal peptide | BAASS protein targeting signal |
| 108 | SEKDEL signal peptide | SEKDEL protein targeting signal amino acid sequence |
| 109 | xHvVSD targeting signal | xHvVSD protein targeting signal amino acid sequence |
| 110 | ZmUBQm | ZmUBQm translational fusion amino acid sequence |
| 111 | xGZein27ss | xGZein27ss protein targeting signal amino acid sequence |
| 112 | HvAle signal | HvAle protein targeting signal amino acid sequence |
| 113 | BAASS coding sequence | BAASS DNA sequence encoding a protein targeting signal |
| 114 | SEKDEL coding sequence | SEKDEL DNA sequence encoding a protein targeting signal |
| 115 | xHvVSD coding sequence | xHvVSD DNA sequence encoding a protein targeting signal |
| 116 | ZmUBQm coding sequence | ZmUBQm DNA sequence encoding a translational fusion |
| 117 | xGZein27ss coding sequence | xGZein27ss DNA sequence encoding a protein targeting signal |
| 118 | HvAle coding sequence | HvAle DNA sequence encoding a protein targeting signal |
| 119 | ZmUbi1P:xGZein27ss:BD22308:xHvVSD | ZmUbi1P:xGZein27ss:BD22308:xHvVSD expression for cassette for one enzyme |
| 120 | ZmPepCP:xGZein27ss:BD25243:SEKDEL | ZmPepCP:xGZein27ss:BD25243:SEKDEL expression cassette for one enzyme |
| 121 | OsUbi3P:EU591743 | OsUbi3P:EU591743 expression cassette for one enzyme |
| 122 | ZmUbi1P:EU591743:AS146-7:SEKDEL | ZmUbi1P:BAASS:EU591743:AS146-7:SEKDEL expression cassette for one intein-modified enzyme |
| 123 | ZmUbi1P:HvAle:NtEGm:SEKDEL | ZmUbi1P:HvAle:NtEGm:SEKDEL expression cassette for one enzyme |
| 124 | ZmPepCP:HvAle:NtEGm:SEKDEL | ZmPepCP:HvAle:NtEGm:SEKDEL expression cassette for one enzyme |
| 125 | OsUbi3P:HvAle:NtEGm:SEKDEL | OsUbi3P:HvAle:NtEGm:SEKDEL expression cassette for one enzyme |
| 126 | OsUbi3P:BAASS:O33897 | OsUbi3P:BAASS:O33897 expression cassette for one enzyme |
| 127 | ZmPepCP:BAASS:O43097:SEKDEL | ZmPepCP:BAASS:O43097:SEKDEL expression cassette for one enzyme |
| 128 | OsUbi3P:O68438 | OsUbi3P:O68438 expression cassette for one enzyme |
| 129 | OsUbi3P:P0C2S1 | OsUbi3P:P0C2S1 expression for cassette for one enzyme |
| 130 | ZmUbi1P:ZmUBQm:BAASS:P77853:S158-30-108-35 | ZmUbi1P:ZmUBQm:BAASS:P77853:S158-30-108-35 expression cassette for one intein-modified enzyme |
| 131 | ZmUbi1P:BAASS:P77853:T134-100-101:SEKDEL | ZmUbi1P:BAASS:P77853:T134-100-101:SEKDEL expression cassette for one intein-modified enzyme |
| 132 | 2379 | 2379 construct containing expression cassettes for three CWDEs and one hpRNA |
| 133 | 2380 | 2380 construct containing expression cassettes for three CWDEs and one hpRNA |
| 134 | 4106 | 4106 construct containing expression cassettes for three CWDEs and one hpRNA |
| 135 | 4107 | 4107 construct containing expression cassettes for three CWDEs and one hpRNA |
| 136 | 4108 | 4108 construct containing expression cassettes for three CWDEs and one hpRNA |
| 137 | 4109 | 4109 construct containing expression cassettes for three CWDEs and one hpRNA |
| 138 | 4110 | 4110 construct containing expression cassettes for three CWDEs and one hpRNA |
| 139 | 4111 | 4111 construct containing expression cassettes for three CWDEs and one hpRNA |
| 140 | 4112 | 4112 construct containing expression cassettes for three CWDEs and one hpRNA |

TABLE 1-continued

Description of Sequences.

| SEQ ID NO | Sequence Name | Sequence Description |
|---|---|---|
| 141 | 4113 | 4113 construct containing expression cassettes for three CWDEs and one hpRNA |
| 142 | 4114 | 4114 construct containing expression cassettes for three CWDEs and one hpRNA |
| 143 | 4115 | 4115 construct containing expression cassettes for three CWDEs and one hpRNA |
| 144 | 4116 | 4116 construct containing expression cassettes for three CWDEs and one hpRNA |
| 145 | 4117 | 4117 construct containing expression cassettes for three CWDEs and one hpRNA |
| 146 | 4120 | 4120 construct containing expression cassettes for three CWDEs and one hpRNA |
| 147 | 4121 | 4121 construct containing expression cassettes for three CWDEs and one hpRNA |
| 148 | 4124 | 4124 construct containing expression cassettes for two CWDEs and one hpRNA |
| 149 | 4125 | 4125 construct containing expression cassettes for two CWDEs and one hpRNA |
| 150 | 4514 | 4514 construct containing expression cassettes for three CWDEs and one hpRNA |
| 151 | 4515 | 4515 construct containing expression cassettes for three CWDEs and one hpRNA |
| 152 | Synthetic construct, ZmGWD1 intron-splicing site | Nucleic acid of ZmGWD1 intron-splicing site |
| 153 | Synthetic construct, GWD forward primer | ob1659, nucleic acid of forward primer |
| 154 | Synthetic construct, GWD reverse primer | ob1660, nucleic acid of reverse primer |
| 155 | Synthetic construct, beta-actin forward primer | ob1555, nucleic acid of forward primer |
| 156 | Synthetic construct, beta-actin reverse primer | ob1556, nucleic acid of reverse primer |
| 157 | Synthetic construct, GADPH forward primer | ob1567, nucleic acid of forward primer |
| 158 | Synthetic construct, GADHP reverse primer | ob1568, nucleic acid of reverse primer |
| 159 | osa-MIR528 | RNA sequence of osa-MIR528 included in FIG. 1 |
| 160 | Amylase 19862 protein | Amylase 19862 amino acid sequence |
| 161 | Glucoamylase 20082 protein | Glucoamylase 20082 amino acid sequence |
| 162 | Glucoamylase 20707 protein | Glucoamylase 20707 amino acid sequence |
| 163 | Amylase 21853 protein | Amylase 21853 amino acid sequence |
| 164 | Amylase 19862 coding sequence | Amylase 19862 coding sequence |
| 165 | Glucoamylase 20082 coding sequence | Glucoamylase 20082 coding sequence |
| 166 | Glucoamylase 20707 coding sequence | Glucoamylase 20707 coding sequence |
| 167 | Amylase 21853 coding sequence | Amylase 21853 coding sequence |
| 168 | AmyS coding sequence | AmyS amylase coding sequence |
| 169 | AmyS protein | AmyS amylase amino acid sequence |
| 170 | GlaA coding sequence | GlaA coding sequence |
| 171 | GlaA protein | GlaA amino acid sequence |
| 172 | An inverted complement of OsDSP1 | A sequence complimentary to OsDSP1 (SEQ ID NO: 40) with a reverse order of nucleotides |
| 173 | GWD gene Os06g30310 | genomic sequence GWD gene Os06g30310 |
| 174 | DSP gene Os03g01750 | genomic sequence DSP gene Os03g01750 |
| 175 | ISA3 gene Os09g29404 | genomic sequence ISA3 gene Os09g29404 |
| 176 | GWD coding sequence -1 | nucleotide sequence encoding GWD target protein from rice [similar to SEQ ID NO: 7 plus 147 additional nucleotides at the 5' end and 12 additional nucleotides at the 3' end] |
| 177 | DSP coding sequence -1 | DSP coding sequence from rice [similar to SEQ ID NO: 31 plus 18 additional nucleotides at 5' end and 12 additional nucleotides at the 3' end] |
| 178 | ISA3 coding sequence | ISA3 coding sequence |
| 179 | Synthetic construct, GWD1 driver sequence | GWD1 driver sequence |
| 180 | Synthetic construct, construct, GWD2 driver sequence | GWD2 driver sequence |
| 181 | Portion of GWD2 in FIG. 4 | Portion of GWD2 in FIG. 4 |
| 182 | Portion of S. lyco. GWD gene in FIG. 4 | Portion of S. lyco. GWD gene in FIG. 4 |
| 183 | DSP1 driver sequence | DSP1 driver sequence |
| 184 | ISA3 driver sequence | ISA3 driver sequence |
| 185 | Synthetic construct, pAL409 | pAL409 |
| 186 | Synthetic construct, pAG2004 | pAG2004 |
| 187 | Synthetic construct, pAG2100 | pAG2100 |
| 188 | Synthetic construct, pAG2101 | pAG2101 |
| 189 | Synthetic construct, pAG2102 | pAG2102 |
| 190 | Synthetic construct, pAG2103 | pAG2103 |
| 191 | *Sorghum bicolor* GWD gene-1 | Putative *Sorghum bicolor* GWD gene |
| 192 | Portion of putative *sorghum bicolor* GWD gene | Portion of putative *Sorghum bicolor* GWD gene corresponding to GWD2 region of rice gene |
| 193 | Synthetic construct, sbGWDk02a | sbGWDk02a |
| 194 | Synthetic construct, sbGWDk2b | sbGWDk2b |
| 195 | Synthetic construct, pAG2106 | pAG2106 |
| 196 | OsGWD excerpt 1 | OsGWD excerpt 1 |
| 197 | sbGWD excerpt 1 | sbGWD excerpt 1 |
| 198 | ZmGWD excerpt 1, n, is any nucleotide | ZmGWD excerpt 1 |
| 199 | SlGWD excerpt 1 | SlGWD excerpt 1 |
| 200 | OsGWD excerpt 2 | OsGWD excerpt 2 |
| 201 | SbGWD excerpt 2 | SbGWD excerpt 2 |
| 202 | ZmGWD excerpt 2 | ZmGWD excerpt 2 |
| 203 | SlGWD excerpt 2 | SlGWD excerpt 2 |
| 204 | Synthetic construct, dgGWDup2 (PCR Primer) | dgGWDup2 (PCR Primer) |
| 205 | Synthetic construct, dgGWD down 2 (PCR Primer) | dgGWD down 2 (PCR Primer) |
| 206 | PvGWD-2 | PvGWD-2 |
| 207 | PvGWD-5 | PvGWD-5 |
| 208 | PvGWD-1 | PvGWD-1 |
| 209 | Synthetic construct, PvGWDko2 RNAi driver sequence | PvGWDko2 RNAi driver sequence |
| 210 | Synthetic construct, pAG2104 | pAG2104 |
| 211 | PvGWDi-1 | PvGWDi-1 |
| 212 | PvGWDi-2 | PvGWDi-2 |
| 213 | PvGWDi-3 | PvGWDi-3 |
| 214 | PvGWDi-4 | PvGWDi-4 |
| 215 | Switchgrass amalgamated sequence; n, is any nucleotide | Switchgrass amalgamated sequence |

TABLE 1-continued

Description of Sequences.

| SEQ ID NO | Sequence Name | Sequence Description |
|---|---|---|
| 216 | Synthetic sequence, sbGWDko2a minus flanking sequence | Synthetic sequence, sbGWDko2a minus flanking sequence |
| 217 | Synthetic sequence, antisense sbGWDko2b | Synthetic sequence, antisense sbGWDko2b |
| 218 | Synthetic sequence, pAL409jSbGWDko2 | Synthetic sequence, pAL409jSbGWDko2 |
| 219 | Synthetic construct, 4206 | 4206 construct containing expression cassettes for three CWDEs |

Example 4

Rice RNAi Constructs

Three exemplary genes to target for RNA interference in rice are GWD, DSP, and ISA3. SEQ ID NOS: 173 [GWD gene os06g30310]-175 [ISA3 geneos09g29404] list the sequences for the rice GWD, DSP and ISA3 genes, respectively. SEQ ID NOS: 176 [GWD coding sequence]-178 [ISA3 coding sequence] list the predicted coding sequences for the GWD, DSP and ISA3 genes, respectively. The GWD, DSP, and ISA3 gene sequences are from the RiceGE database: accession Nos. Os06g30310 (GWD); Os03g01750 (DSP); and Os09g29404 (ISA3).

Based on the coding sequences in SEQ ID NOS: 176 [GWD coding sequence]-178 [ISA3 coding sequence], artificial cDNAs were synthesized and provided a resource for expressing the corresponding proteins in heterologous systems (e.g., E. coli or yeasts), which in turn would make it possible to raise antibodies for use in analyzing the planned transgenic plants.

Plasmid DNAs carrying the entire coding sequences of SEQ ID NOS: SEQ ID NOS: 176 [GWD coding sequence]-178 [ISA3 coding sequence] were used as templates in PCR reactions to prepare driver sequences to be used in the RNAi constructs. For the GWD gene, two separate driver sequences were prepared.

```
>GWD1 driver sequence (one copy)
                                    [SEQ ID NO: 179]
TAGCGCTAAGGAAGGGAGAGATATCCATCCGGATCCCGGAAGCCGAATCC

ATCCATCCATCCATCCCATACTGCCCTTACGATCGAGCTGTTTGATATTC

GTGCAGATGAGCGGATTCTCCGCGGCAGCTGCTGCGGCCGAGCGCTTGTC

GGAAGGTTCACCCTGGATGCCAACTCCGAGCTTAAGGTGACATTGAACCC

AGCACCGCAGGGTTCGGTGGTGGAGATCAATCTAGAGGCAACTAACACCA

GCGGCTCCCTGATACTGCATTGGGGCGCCCTTCGCCCGGATAGAGGAGAA

TGGCTCCTACCAT

>GWD2 driver sequence (one copy)
                                    [SEQ ID NO: 180]
AGCAGATCTAGTTGACCAAGCAAGAGATAATGGATTATTGGGTATTATTG

GAATTTTTGTTTGGATTAGGTTCATGGCTACAAGGCAACTAATATGGAAC

AAGAACTACAATGTGAAGCCACGTGAGATAAGCAAAGCACAAGATAGGTT

TACAGATGATCTTGAGAATATGTACAGAACTTACCCACAATATCAGGAGA

TCTTAAGAATGATAATGTCTGCTGTTGGTCGGGGAGGTGAAGGTGATGTT

GGTCAACGCATTCGTGATGAGATATTAGTAATCCAGAGAAATAATGACTG

CAAAGGTGGAATGATGGAGGAGTGGCACCAGAAACTGCACAACAATACAA

GCCCAGATGATGTAGTGATCTGCCAGGCCCTACTTGATTATATCAAGAGT

GATTTTGATATTGGTGTTTACTGGGACACCTTGAAAAAAGATGGTATAAC

AAAAGAGCGTCTATTGAGCTATGATCGACCGATTCATTCAGAGCCAAATT

TCAGGAGTGAACAGAAAGATGGCTTACTCCGTGACTTGGGCAATTATATG

AGAAGCCTCAAGATGGAGGGTACCC
```

GWD1 is derived from a region near the 5' end of the GWD coding sequence. The second GWD driver sequence, GWD2 is derived from a region closer to the middle of the GWD coding sequence, which corresponds to a region of relatively higher sequence conservation among GWD genes from divergent species. See FIG. 7, which illustrates a comparison between GWD2, derived from the rice glucan water dikinase gene, and the GWD gene from tomato (Solanum lycopersicon). Unexpectedly, BLAST analysis [Zhang Z, Schwartz S, Wagner L, and Miller W, A greedy algorithm for aligning DNA sequences (2000) J Comput Biol 2000; 7(1-2):203-14, which is incorporated herein by reference as if fully set forth] of these two sequences reveals extensive homology, despite the phylogenetic distance that separates these two species (rice is a monocot, while tomato is a dicot). This suggests that this portion of the GWD gene would serve as a broadly applicable target for RNA interference. In FIG. 7, the Query (top sequence) is a portion of rice GWD2 driver sequence [SEQ ID NO: 181; and the Sbjct (bottom sequence) is tomato GWD cDNA sequence [SEQ ID NO: 182]. Because of the sequence homology across this region, it is possible that an RNAi construct targeted against this region in the rice gene might also be useful for suppressing expression of homologous GWD genes in other plant species. Embodiments include methods, vectors and transgenic plants including sequences for RNAi targeting GWD.

Portions of the DSP and ISA3 genes from rice were also selected to serve as driver sequences.

```
>DSP1 driver sequence
                                    [SEQ ID NO: 183]
CTCCAATCGTGGGATCCAGGTCCATGAGGCGGCCCTCGCCGCTCAATCTG

ACGATGGTTCGTGGCGGGAGTCGCCGATCAAACACTGTCAAAACCGCATC

CGGGGCGTCTACTTCTAGCGCCGAGAGTGGCGCAGTGGAGGCGGGCACGG

AGAAATCCGATACGTACAGCACCAACATGACGCAAGCTATGGGAGCAGTG

TTGACGTATAGACATGAGCTTGGAATGAACTACAATTTCATACGCCCAGA

CTTGATCGTGGGCTCCTGCTTACAGAGCCCACTTGATGTTGATAAACTTA

GGGACATTGGTGTAAAAACAGTATTCTGCCTGCAGCAAGATCCAGACCTT

GAATATTTTGGAGTTGACATCTGTGCCATT

>ISA3 driver sequence
                                    [SEQ ID NO: 184]
CTAGCGAATACACTGAACTGCAACCATCCTGTTGTCAAGGAGCTCATTCT

TGACAGCTTGAGACACTGGGTTGAGGAGTATCACATAGATGGATTTCGAT

TTGACCTTGCAAGTGTTCTTTGTCGTGGACCAGATGGTTGTCCTCTTGAT
```

-continued

```
GCACCTCCACTCATCAAGGAAATTGCCAAAGATGCTGTATTATCTAGATG

TAAGATCATTGCTGAACCTTGGGATTGCGGCGGCCTTTATCTCGTAGGGC

GTTTCCCTAACTGGGACAGGTGGGCTGAATGGAACGGCAAATACAGAGAT

GATCTTCGAAGATTTATTAAGGGTGACCCTGGTATGAAGGGGGTGTTTGC

GACTCGTGTGTCTGGATCTGCTGATCTCTATCAGGTGAACGAGCGGAAGC

CTTACCATGGTGTAAATTTTGTGATTGCACATGATGGATTTACTTTATGT

GACCTTGTTTCTTACAACTTAAAGCACAATGATGCTAATGGAGAAGGTGG

CTGTGATGGATC
```

GWD1, GWD2, DSP1 and ISA3 driver sequences were each amplified by PCR such that each was flanked with restriction enzyme recognition sites (e.g., NheI and XmaI). The fragments were first ligated into pCRBlunt II TOPO (Invitrogen), confirmed via multiple restriction enzyme digests and sequencing, then excised (using restriction enzymes that cleave the introduced flanking sites) and ligated first into the BspEI and AvrII sites and then the NheI and AgeI sites of pAL409 (FIG. 2), which positioned the two copies in opposite orientations. The resulting RNAi cassettes were excised from the pAL409 derivatives as PacI-XmaI fragments and ligated into pAG2004 (FIG. 6), resulting in the plasmids pAG2100, pAG2102, and pAG2103. FIG. 6 shows RNAi cassettes targeting rice GWD, DSP, and ISA3 genes, where the top two segments are derived from the GWD gene, the middle from DSP and the bottom from ISA3 genes. Each of the driver elements is represented as duplicate inverted copies separated by and proximal to the OsUbi3 intron. On the left are listed the names of the constructs that were assembled in the plasmid pAL409. To the right are listed the names of the plasmids that resulted when the RNAi cassettes were excised from pAL409 as PacI-XmaI fragments and inserted into pAG2004.

Still referring to FIG. 6, the pAL409-GWDko1 construct includes P-OsUbi promoter 331, GWD1 driver sequence 310, OsUbi intron 301, inverted GWD1 driver sequence 311 and the NOS 3' polyadenylation sequence 381. The pAL409-GWDko2 construct includes P-OsUbi promoter 332, GWD2 driver sequence 312, OsUbi intron 302, inverted GWD2 driver sequence 313 and the NOS 3' polyadenylation sequence 382. The pAL409-DSPko1 construct includes P-OsUbi promoter 333, DSP1 driver sequence 314, OsUbi intron 303, inverted DSP1 driver sequence 315 and the NOS 3' polyadenylation sequence 383. The pAL409-ISA3ko1 construct includes P-OsUbi promoter 334, ISA3 driver sequence 316, OsUbi intron 304, inverted ISA3 driver sequence 317 and the NOS 3' polyadenylation sequence 384. Replacement of the PacI-XmaI fragment of pAG2004 with the PacI-XmaI fragments of constructs pAL409-GWDko1, pAL409-GWDko2, pAL409-DSPko1 and pAL409-ISA3ko1 produced the plasmids pAG2100 [SEQ ID NO: 187], pAG2101 [SEQ ID NO: 188], pAG2102 [SEQ ID NO: 189] and pAG2103 [SEQ ID NO: 190], respectively.

Example 5

Sorghum RNAi Construct

A draft of the genomic sequence corresponding to the putative GWD gene from Sorghum bicolor [SEQ ID NO: 191] was obtained through the Joint Genome Institute (JGI) Sorghum bicolor Home Page (http://genome.jgi-psf.org/Sorbi1/Sorbi1.home.html). From this sequence, a region corresponding roughly to the GWD2 region of the rice gene [SEQ ID NO: 192] was identified. In sorghum, the coding sequences in this region are interrupted by one or more introns, as identified by JGI, and the introns are at approximately nucleotides 140-342, nucleotides 507-628 and nucleotides 723-795 in [SEQ ID NO: 192]. A native intron derived from the sorghum genome was utilized in assembling an RNAi cassette for knocking down the GWD gene from sorghum. A portion of the sorghum GWD gene was amplified. The portion amplified included one full exon (based on the JGI prediction) in the highly conserved middle region (described earlier, see FIG. 7, the adjacent intron, and 10 bases of the subsequent exon (to preserve the 3' intron/exon boundary). An XmaI site was incorporated upstream of the first exon, and AgeI and NheI sites were incorporated downstream of the truncated second exon during PCR amplification of this product. This product (SbGWDko2a) was first ligated into pCRBluntII TOPO (Invitrogen), and its composition was confirmed via multiple restriction enzyme digests and sequencing.

```
>SbGWDko2a (with flanking restriction sites)
                                    [SEQ ID NO: 193]
GGTTCAATAACCCGGGAGTGAGATAAGCAAAGCACAAGATAGGTTTACAG

ATGATCTTGAGAATATGTACAGAACTTATCCTCAGTACAGAGAGATACTA

AGAATGATAATGGCTGCTGTTGGTCGTGGAGGTGAAGGTGACGTTGGTCA

ACGCATTCGTGATGAGATATTAGTAATACAGGTAAAACTGATGGTCCTTG

GTGAATATACAGTTATTTTCGTTCATTGCTCTGCTGAATTGAGCAGTTGG

TAGTGCTCATCCAAAACGTAGACATTGTCAACAATAAAATGTTTGGTGTG

TTACAGAGAAATACCGGTGCAAAGCTAGCATGATGGAAGAATGG
```

A second PCR product (SbGWDko2b), corresponding to only the first exon mentioned above, was also amplified by PCR with flanking NheI and XmaI sites introduced at the 5' and 3' ends (relative to the direction of transcription), and ligated into pCRBluntII TOPO. The composition of this fragment was also confirmed via multiple restriction enzyme digests and sequencing.

```
>SbGWDko2b (with flanking restriction sites)
                                    [SEQ ID NO: 194]
GGTTCAATAAGCTAGCAGTGAGATAAGCAAAGCACAAGATAGGTTTACAG

ATGATCTTGAGAATATGTACAGAACTTATCCTCAGTACAGAGAGATACTA

AGAATGATAATGGCTGCTGTTGGTCGTGGAGGTGAAGGTGACGTTGGTCA

ACGCATTCGTGATGAGATATTAGTAATACAGCCCGGGCTGATGGTCC
```

Figure 8:
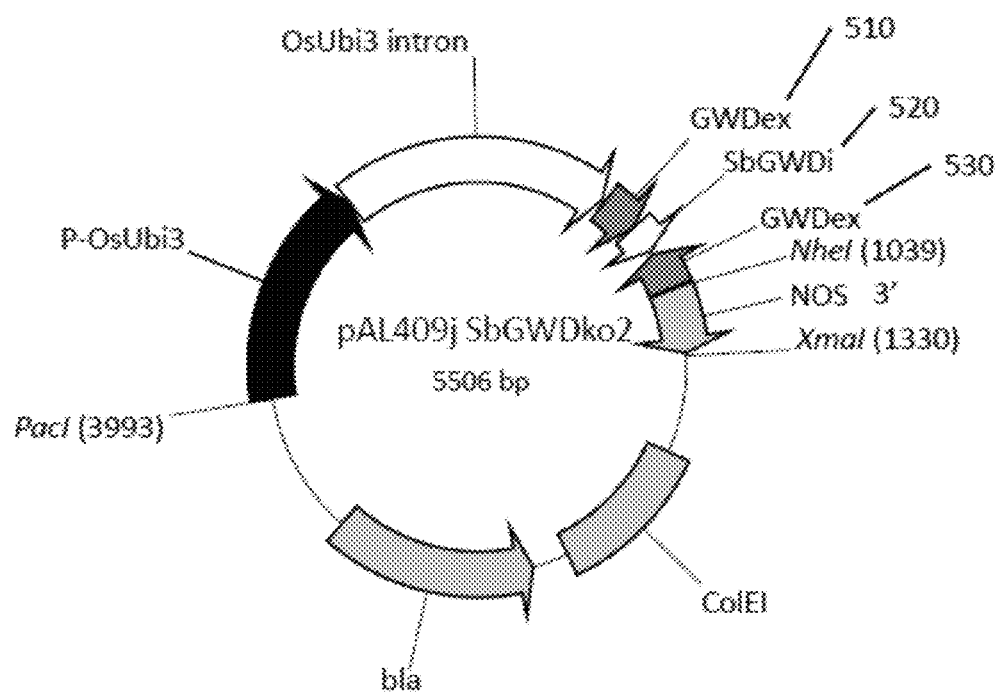
FIG. 8 illustrates pAL409j SbGWDko2.

Next SbGWDko2b was excised from pCRBlunt II as an NheI-XmaI fragment, and ligated into the NheI and AgeI sites of the plasmid carrying SbGWDko2a, positioning SbGWDko2b downstream of the intron and in the opposite orientation of SbGWDko2a. In this orientation, sequences in the sbGWDko2b portion of the plasmid are presented as an inverted complement of sequences within the sbGWDko2a portion. Referring to FIG. 8, this entire cassette was excised as an XmaI-NheI fragment and ligated into pAL409j, resulting in the plasmid pAL409j SbGWDko2 [SEQ ID NO: 218]. pAL409j carries an RNAi cassette targeting the GWD gene of Sorghum bicolor. The driver sequence 510 (sbGWDko2a) is illustrated in FIG. 8 upstream of the intron 520 (sbGWDi), which is illustrated upstream of the driver sequence 530

(sbGWDko2b). pAL409j differs from pAL409 only in that the junction between the OsUbi3 promoter and the OsUbi3i intron have been modified to reflect their native context in the rice genome. As such, this orientation may preserve the enhancer functions of OsUbi3i with respect to the OsUbi3 promoter. As shown in FIG. 8, two inverted, homologous driver sequences derived from an exon within the sorghum GWD gene (GWDex) are separated by a native sorghum GWD exon (SbGWDi). Other elements are named as in FIG. 2.

The entire RNAi cassette from pAL409j SbGWDko2 was then excised as a PacI-XmaI fragment and ligated into the PacI and XmaI sites of pAG2004, producing the *Agrobacterium* transformation vector pAG2106 [SEQ ID NO: 195] in a manner similar to that described in reference to FIG. 6. An *E. coli* strain carrying pAG2106 was used for conjugation to *Agrobacterium* and subsequent transformation of sorghum.

Example 6

Sequencing of the Switchgrass GWD Gene(s)

Figure 9:
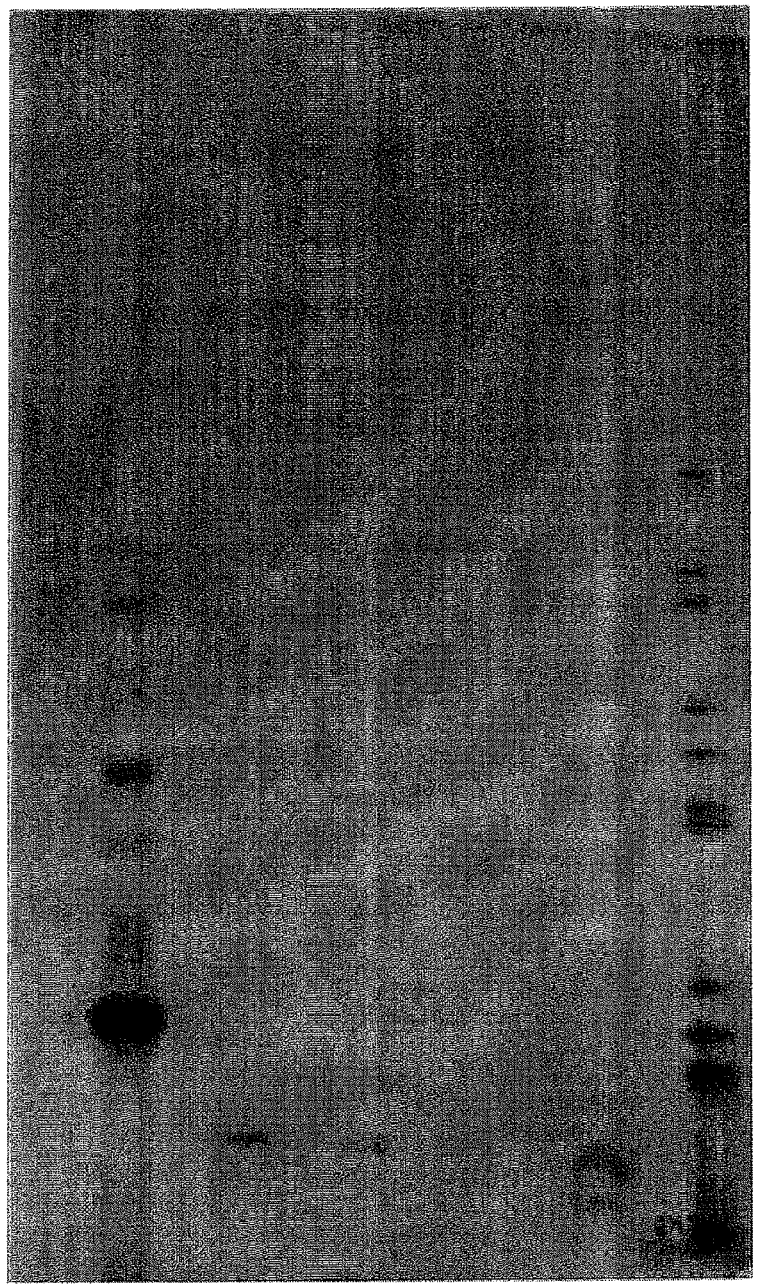
FIG. 9 illustrates detection of ISA3 homologues via Southern blot.

Homologues for GWD and ISA3 were detected in the switchgrass genome and the number of homologues that are present for each were estimated using a Southern blotting strategy. Results with the Southern blot using the rice ISA3 probe are shown in FIG. 9. FIG. 9 shows detection of ISA3 homologues via Southern blot. Genomic DNA was extracted from rice, sorghum, maize, and switchgrass, digested with HindIII, and separated via agarose gel electrophoresis. DNAs were subsequently transferred to nylon membranes via capillary blotting, and the blots probed with DIG-labeled DNA derived from the cloned rice ISA3 gene. Whereas the probe hybridized to only single fragments in rice and sorghum, the same probe hybridized to 3-5 fragments in the maize and switchgrass genomes. The control was plasmid DNA carrying the rice ISA3 coding sequence; and the marker was DNA molecular weight standards. Similar results were obtained when the rice GWD2 fragment was used as a probe (not shown). It was determined that, unlike rice and sorghum, which contain only single copies of GWD and ISA3, switchgrass contains multiple homologues of each of these genes.

A portion of the switchgrass GWD gene was identified and clones using a degenerate PCR approach. Degenerate PCR employs oligonucleotide primers with one or more ambiguous bases that allow the primers to anneal to template sequences for which only approximate sequence information is available. That is, in regions of strong sequence conservation between genes of widely divergent species, one can infer the range of possible sequences that might be present in the corresponding gene from an under-characterized species such as switchgrass. One can then design degenerate primers that will anneal to the predicted sequences, permitting PCR amplification and cloning of a portion of the gene in question.

Pursuing the degenerate PCR strategy, portions of the GWD genes derived from rice, sorghum, maize, and tomato were aligned. The strongest alignments occurred in the region of the GWD genes that was described in FIG. 7. Short (~40 nt) regions near the extremities of these regions of homology were selected for a more detailed sequence comparison (FIG. 10). FIG. 10 illustrates alignment of excerpts from the GWD genes of rice (OsGWD) [SEQ ID NOS: 24 (top) and 28 (bottom)], sorghum (SbGWD) [SEQ ID NOS: 25 (top) and 29 (bottom)], maize (ZmGWD) [SEQ ID NOS: 198 (top) and 202 (bottom)], and tomato (SlGWD) [SEQ ID NOS: 199 (top) and 203 (bottom)]. Nucleotide positions that are conserved in at least two of the four sequences are highlighted in light gray and underlined. Beneath each set is presented the consensus sequence to which degenerate primers (dgGWDup2 and dgGWDdown2 [SEQ ID NOS: 204 and 205, respectively]) were designed for PCR amplification. Note that only partial sequence is available for the maize homologue, with a region of unknown sequence represented by Ns. The four sequences aligned in the top segment correspond to the portion of the GWD coding sequences that can be found from nucleotides 1803-1840 of the tomato coding sequence (as defined in FIG. 7), while the alignments in the bottom segment correspond to nucleotides 2208-2249 of the tomato sequence. Nucleotide abbreviations for degenerate nucleotides are as follows: Y, C or T; W, A or T; K, G or T; R, A or G, M, A or C; H, A or C or T; S, G or C; D, A or G or T. From this information, degenerate primers were designed (dgGWDup2: 5'-TGGAATTYTT-GTWTGGATKAGRTTCATGGCTACMAGGCA-3' [SEQ ID NO: 204] and dgGWDdown2:5'GGYTCWGAATGRAT-MGSWCGRTCATARCTCAADAGACGCTCT-3' [SEQ ID NO: 205]). Genomic DNA that had been isolated from sorghum was then used as a template in PCR reactions with these primers. Degenerate PCR with sorghum genomic DNA as a template gave rise to an approximately 800 bp PCR product. Sequencing of this PCR product revealed that it closely matched the sequence that was predicted for the sorghum GWD gene by the JGI database (see above), which indicated that the degenerate primers would reliably amplify a segment of the GWD gene.

The same primers were then used in PCR reactions that used switchgrass (ecotype Alamo) genomic DNA as a template. These reactions produced discrete PCR products of approximately 1100 bp. These products were ligated into pCRBluntII TOPO and five of the resulting plasmids were sequenced. From these five sequences, it was determined that:

Each cloned PCR product was derived from a gene with very strong homology to the rice GWD gene Among the five sequenced products, there were clearly three classes of (highly homologous) sequences, suggesting that the clones were derived from three different GWD homologues within the switchgrass genome. This observation agrees with the data from Southern blots that suggested multiple GWD genes reside within the switchgrass genome.

The main differences in the sizes of the products that arose from degenerate PCR of sorghum and switchgrass can be attributed to differences in the lengths of the putative introns in each of the respective genes.

Figure 11:
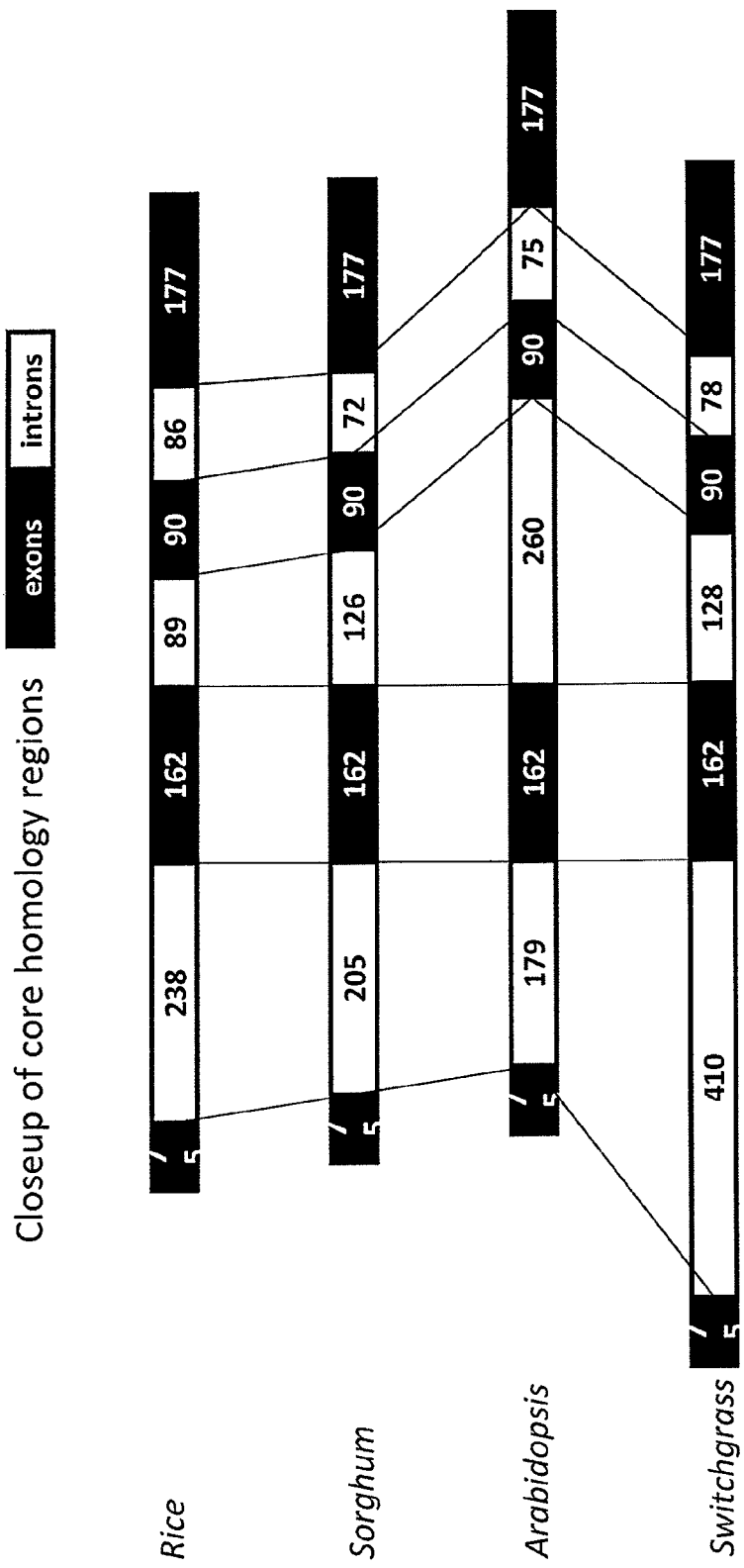
FIG. 11 illustrates comparison of relative length and positioning of introns within the core homology segment of GWD genes from rice, sorghum, *Arabidopsis*, and switchgrass.

Referring to FIG. 11, a comparison of relative length and positioning of introns within the core homology segment of GWD genes from rice, sorghum, *Arabidopsis*, and switchgrass is illustrated. Dark boxes represent exons, and light boxes represent introns. Exon sequences are very well conserved and easily recognized. While the relative positions of each of the introns is also well conserved across species, the length and sequence of the introns is not well conserved. Lengths of the introns and exons are indicated in by within each element.

As shown below, an alignment of the sequences from three of the switchgrass-derived degenerate PCR products, demonstrates that relatively few single nucleotide changes and two somewhat lengthier insertions/deletions distinguish these three GWD homologues in this region. These three products are PvGWD-2 [SEQ ID NO: 206], PvGWD-5 [SEQ ID NO: 207] and PvGWD-1 [SEQ ID NO: 208].

```
CLUSTAL 2.0.10 multiple sequence alignment
PvGWD-2    TGGAATTCTTGTTTGGATGAGATTCATGGCTACCAGGCAACTAACATGGAATAAGAACTA      60
PvGWD-5    TGGAATTCTTGTTTGGATTAGGTTCATGGCTACCAGGCAACTAACATGGAATAAGAACTA      60
PvGWD-1    TGGAATTTTTGTTTGGATGAGATTCATGGCTACAAGACAACTGACATGGAATAAGAACTA      60
           ****** ********** ** ********** ** ***** ******************

PvGWD-2    TAATGTGAAGCCCCGGTATATACCTGTCTTTATCATTTACTTCAGTGATGTTTACTCTCT     120
PvGWD-5    TAATGTGAAGCCCCGGTATATACCTGTCTTTATCATTTACTTCAGTGATGTTTACTCTCT     120
PvGWD-1    TAATGTGAAGCCACGGTATATACCTGTCTTTATTATTTACTTCAGTAATGTTTACTCTCT     120
           ************ ******************** *********** *************

PvGWD-2    GCTTAAAAATTTAAAGAATCTGAAGCTGTCCTTTTCTTTTGTGCGGGAACATAATTGAGA     180
PvGWD-5    GCTTAAAAATTTAAAGAATCTGAAGCTGTCCTTTTCTTTTGTGCGGGAACATATTGAGA      180
PvGWD-1    GCTTTAAAAGTTAAAGAATCAGAAGTTGTCCCTTTCTTTTGTGCGGGAACATAATTGAAA     180
           **** **** ********* **** ***** ******************** ****  *

PvGWD-2    AATTGGTGTTTTTGCCACTACTTCATGATGCAATTGTAATTTTTCCCTCATTTTTTTCAA     240
PvGWD-5    AATTGGTGTTTTTGCCACTACTTCATGATGCAATTGTAATTTTTCCCTCATTTTTTTCAA     240
PvGWD-1    AGTTGGTGTTCTTGCCACTAC---------------------------------------     201
           * ******** **********

PvGWD-2    CTTTGTGATTTTGCCCTTTACTATTCACAAGTCAACGCAATTTTGCTCCTGTTTTGACCG     300
PvGWD-5    CTTTGTGATTTTGCCCTTTACTATTCACAAGTCAACGCAATTTTGCTCCTGTTTTGACCG     300
PvGWD-1    --------------------------AAGTCAACGCGATTTTACCCCT-CGTCAACGG      232
                                     ********** ***** *    **  *

PvGWD-2    TTGACTGAG-GGAAAAATCGCGTTAACTTGTGAATAGTAAGTGCAAAATTGCAAAGTTGA     359
PvGWD-5    TTGACTGAG-GGAAAAATCGCGTTAACTTGTGAATAGTAAGTGCAAAATTGCAAAGTTGA     359
PvGWD-1    TCAAAACAGTAGCAAAATCGCGTTGACTTGTGAATAGTAAGGGCAAA-TCACAAAGTTGG     291
           *   *  **  * *********** **************** *****  * ********

PvGWD-2    AAAAAACAAGGACAAAATCACAATTGCACTGCAAAGTAGGGGTGGAAACACAAATGCCCC     419
PvGWD-5    AAAAAACAAGGACAAAATCACAATTGCACTGCAAAGTAGGGGTGGAAACACAAATGCCCC     419
PvGWD-1    AAAAAACAAGGACAAAATCACAATTGCACTGCAAAGTAGTCGCGGAAACACAAATGCCCC     351
           ***************************************  * ****************

PvGWD-2    AAAATAATTTGGCTGTTTGTCCTGATAGAAAACAATACAATTCAGTACTCAGAGAATATT     479
PvGWD-5    AAAATAATTTGGCTGTTTGTCCTGATAGAAAACAATACAATTCAGTACTAAGAGAATATT     479
PvGWD-1    AAAATAATTTGGCTGTTTGTCCTGATAAAAAACAATACAATTCAGTACTCAGAGAATATT     411
           ***************************  ******************* **********

PvGWD-2    ATATTTCTATAAATGAAAAACATAACTCATGTCACATTCTTT--------GGCATCTCAT     531
PvGWD-5    ATATTTCTATAAATGAAAAACATAACTCATGTCACATTCTTT--------GGCATCTCAT     531
PvGWD-1    ATATTTCTATAAATGAAAAACATAACTCATGTCGCATTCTTTCATTCTTTGGCATCTCAT     471
           ********************************* ********        **********

PvGWD-2    ATCGATCAATAACTATGCAGTGAGATAAGCAAAGCACAAGATAGGTTTACAGATGATCTT     591
PvGWD-5    ATCGATCAATAACTATGCAGTGAGATAAGCAAAGCACAAGATAGGTTTACAGATGATCTT     591
PvGWD-1    ATTGATTAATAACTACGCAGTGAGATAAGCAAAGCACAAGATAGGTTTACAGATGATCTT     531
           ** *** ******** ********************************************

PvGWD-2    GAGAACATGTACAAAGCTTATCCTCAGTGCAGAGAGATATTAAGAATGATAATGGCTGCT     651
PvGWD-5    GAGAACATGTACAAAGCTTATCCTCAGTGCAGAGAGATATTAAGAATGATAATGGCTGCT     651
PvGWD-1    GAGAACATGTACAAAGCTTATCCTCAGTACAGAGAGATATTAAGAATGATAATGGCTGCT     591
           ***************************  *******************************

PvGWD-2    GTTGGTCGTGGAGGTGAAGGTGATGTTGGTCAACGTATTCGTGATGAGATATTAGTAATA     711
PvGWD-5    GTTGGTCGTGGAGGTGAAGGTGATGTTGGTCAACGTATTCGAGATGAGATATTAGTAATA     711
PvGWD-1    GTTGGTCGTGGAGGTGAAGGTGATGTTGGTCAACGTATTCGTGATGAGATATTAGTAATA     651
           ***************************************** ******************

PvGWD-2    CAGGTAAAATTAATGGTCCTAGGTGAATATACACTTACTTTTATTCATTGCTTCACCGAA     771
PvGWD-5    CAGGTAAAATTAATGGTCCTAGGTGAATATACACTTACTTTTATTCATTGCTTCACTGAA     771
PvGWD-1    CAGGTAAAATTAATGGTCCTAGGTGAATATACACCTACTTTTATTCATTGCTTCACTGAA     711
           ********************************** ********************* ***

PvGWD-2    TTATACGGTTGGTAGTTCTCATCCAAAAGATAGACATTGTGAATAATAATAAAATGCTTG     831
PvGWD-5    TTATACGGTTGGTAGTTCTCATCCAAAAGATAGACATTGTGAATAATAATAAAATGCTTG     831
PvGWD-1    TTATACGGTTGGTAGTTCTGATCCAAAAGATAGACATTGTGAATAATAATAAAATGCTTG     771
           ******************* ****************************************

PvGWD-2    CTGCTTTAATAGAGAAATAATGACTGCAAAGGTGGAATGATGGAAGAATGGCACCAGAAA     891
PvGWD-5    CTGCTTTAATAGAGAAATAATGACTGCAAAGGTGGAATGATGGAAGAATGGCACCAGAAA     891
PvGWD-1    CTGCTTTTATAGAGAAATAATGACTGCAAAGGTGGAATGATGGAAGAATGGCACCAGAAA     831
           ******* ****************************************************

PvGWD-2    TTGCACAACAATACAAGCCCAGATGATGTAGTGATATGCCAGGTAATGGATATTTTGAAT     951
PvGWD-5    TTGCACAACAATACAAGCCCAGATGATGTAGTGATATGCCAGGTAATGGATATTTTGAAT     951
```

-continued

```
PvGWD-1  TTGCACAACAATACAAGCCCAGATGATGTAGTGATATGCCAGGTATTGGATATTTTGAAT     891
         ********************************************** **************

PvGWD-2  TCTTAATACAGTAAGTATTTAAGCATTGAGGTTTTCATGGTTATGTCTCTCCTTGGGCAG    1011
PvGWD-5  TCTTAATACAGTAAGTATTTAAGCATTGAGGTTTTCATGGTTATGTCTCTCCTTGGGCAG    1011
PvGWD-1  TCTTAATACTGTAAGTATTTAAGCATTGAGGTTTTTATGGTTATGTCTCTCCTTGGGCAG     951
         ********* ************************ *************************

PvGWD-2  GCACTAATTGATTATATCAAGAGTGATTTTGATATAAGTGTTTACTGGGACACCTTGAAC    1071
PvGWD-5  GCACTAATTGATTATATCAAGAGTGATTTTGATATAAGTGTTTACTGGGACACCTTGAAC    1071
PvGWD-1  GCATTAATTGATTATATCAAGAGTGATTTTGATATAAGTGTTTACTGGGACACCTTGAAC    1011
         *** ********************************************************

PvGWD-2  AAAAATGGCATAACCAAAGAGCGTCTCTTGAGCTATGATCGAG-CTATCCATTCAGAACC    1130
PvGWD-5  AAAAATGGCATAACCAAAGAGCGTCTATTGAGTTATGACCGTC-CGATCCATTCCAGACC    1130
PvGWD-1  AAAAATGGCATAACCAAAGAGCGTCTTTTGAGCTATGATCGTTGCTATCCATTCAGAACC    1071
         ************************** ***** ***** **  * ********  ***
```

Sequences of the exons from the switchgrass GWD gene(s) were inferred from the above information. The inferred sequences were used to (1) develop an RNAi construct that would target this central region of one or all of the switchgrass GWD genes, and (2) determine more of the genomic sequence for each of these (at least three) GWD homologues in switchgrass.

To develop an RNAi construct, PCR was used to amplify portions from two of the exons encompassed in the degenerate PCR products described above. These two products were then fused by SOE PCR (Horton R. M., Hunt H. D., Ho S, N., Pullen J. K., Pease L. R., Engineering hybrid genes without the use of restriction enzymes: gene splicing by overlap extension (1989) Gene 77(1):61-8), which is incorporated herein by reference as if fully set forth). The fused products included a contiguous sequence that was expected to more closely match one or more of the switchgrass GWD mRNAs. NheI and XmaI sites were incorporated into the termini of the fused product to enable subsequent cloning into pAL409. The sequence of this product (called "PvGWDko2" along with the flanking restriction sites) is depicted below.

>PvGWDko2 RNAi driver sequence
[SEQ ID NO: 209]
GGCTAGCGAGATAAGCAAAGCACAAGATAGGTTTACAGATGATCTTGAGA

ACATGTACAAAGCTTATCCTCAGTACAGAGAGATATTAAGAATGATAATG

GCTGCTGTTGGTCGTGGAGGTGAAGGTGATGTTGGTCAACGTATTCGTGA

TGAGATATTAGTAATACAGGAGAAATAATGACTGCAAAGGTGGAATGATG

GAAGAATGGCACCAGAAATTGCACAACAATACAAGCCCAGATGATGTAGT

GATATGCCCGGGAGG

One copy of this element was ligated into the AvrII and BspEI sites of pAL409, then a second copy was ligated into the NheI and AgeI sites of the resulting plasmid, producing the RNAi cassette pAL409 PvGWDko2, which had the elements arranged in opposite orientations, separated by the OsUbi3 intron, as described in reference to FIG. 6. The RNAi cassette was excised from this plasmid as a PacI-XmaI fragment and ligated into PacI and XmaI sites of pAG2004 (FIG. 6). The resulting Agrobacterium transformation vector was named pAG2104 [SEQ ID NO: 210]. An E. coli strain carrying this plasmid was used for conjugation with Agrobacterium and subsequent transformation of switchgrass.

By learning the complete genomic sequences of each of the GWD genes in switchgrass identification of the potentially unique sequences (5' and 3' untranslated regions) that flank each of these genes may be possible. With this information, it may be able to design RNAi constructs that specifically target one or the other of these genes.

To identify more of the sequences associated with each of the GWD homologues, a strategy was pursued that employed inverse PCR (iPCR) as well as degenerate PCR. Genomic DNA from switchgrass was digested with either EcoRI, HindIII, or Bgl II. These were then subjected to self-ligation, diluted approximately 100-fold, and used as templates in inverse PCR reactions. The sequences of the first primers used in iPCR reactions are summarized in Table 2.

TABLE 2

| Sequences of primers used for inverse PCR | |
|---|---|
| PvGWDi-1 CCGTGGCTTCACATTATAGTTCTTATTCCA | SEQ ID NO: 211 |
| PvGWDi-2 GAGATAAGCAAAGCACAAGATAGGT | SEQ ID NO: 212 |
| PvGWDi-3 GCCTGCCCAAGGAGAGACATAACCA | SEQ ID NO: 213 |
| PvGWDi-4 GATATAAGTGTTTACTGGGACACCT | SEQ ID NO: 214 |

Inverse PCR reactions with either primers PvGWDi-1 and PvGWDi-2 or primers PvGWDi-3 and PvGWDi-4 were carried out using the EcoRI- or HindIII-digested (and self-ligated) templates. These reactions gave rise to a small number of clear products, which were purified from agarose gels and ligated into pCRBluntII-TOPO. Sequence analysis of the resulting plasmids allowed extending the known sequence from switchgrass GWD genes at both the 5' and 3' ends to a total of 3.4 kb. Again, the sequences from individual clones differed by about 1-2%, consistent with the idea that the cloned PCR products were derived from separate but very similar GWD homologues in the switchgrass genome. This exercise was repeated with newly designed primers, incorporating both inverse PCR and degenerate PCR to extend the known sequence further. Approximately 7 kb of switchgrass GWD sequence was identified.

Figure 12:
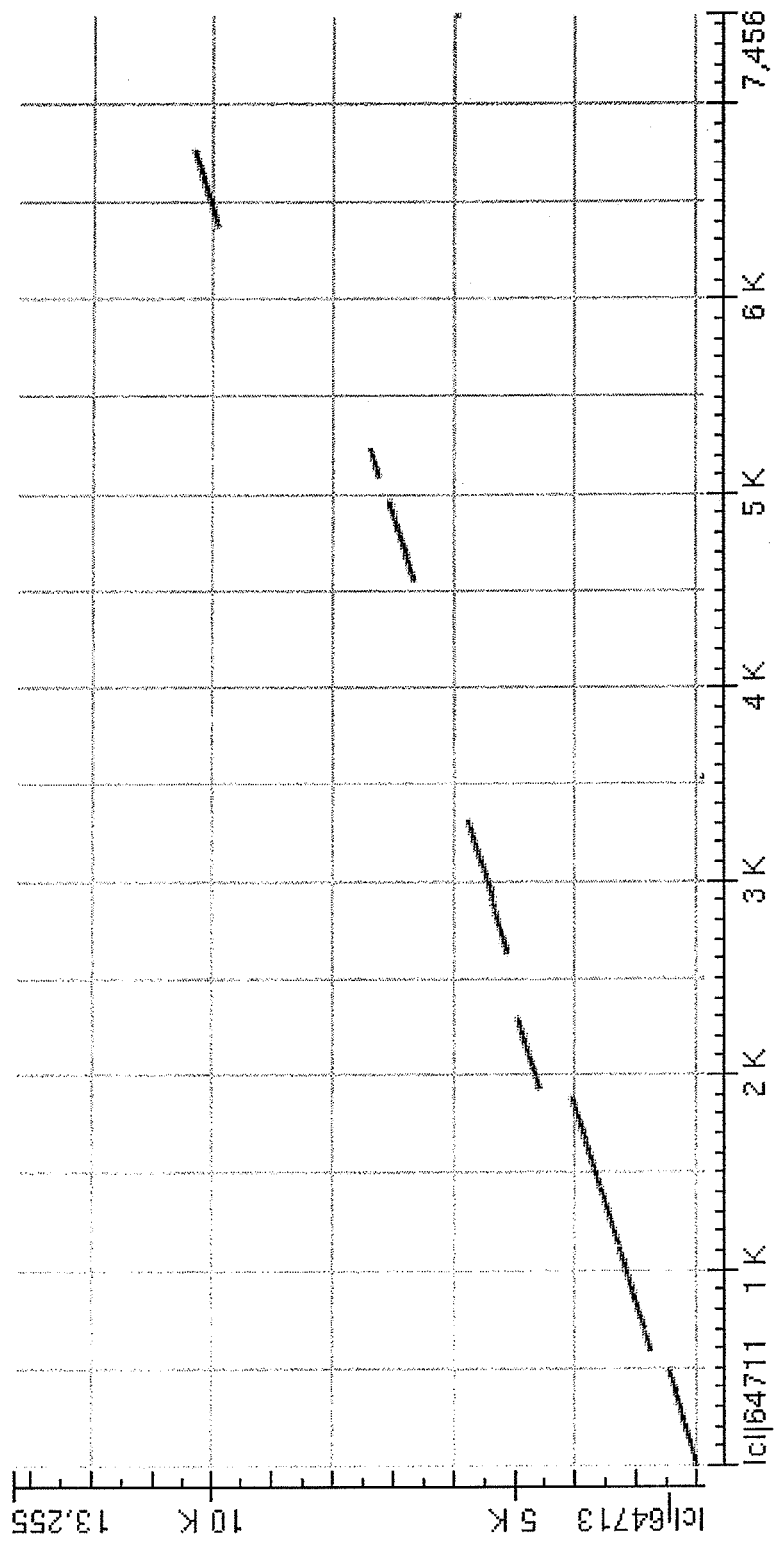
FIG. 12 illustrates a dot matrix depiction of BLASTn alignments between switchgrass and rice genomic sequences for glucan water dikinase genes. Horizontal axis, switchgrass sequence; vertical axis, rice sequence. Diagonal segments represent regions where the two sequences are highly homologous.

An amalgamated sequence is provided representing the switchgrass GWD gene sequences discovered herein. The sequence presented does not include all of the variations identified among the homologues. Thus, the sequence could be viewed as a chimera of these homologues. This sequence straddles a segment of approximately 1-2 kb for which there is no sequence data. This segment is represented as a string of Ns. Referring to FIG. 12, a dot matrix depiction of BLASTn alignments between switchgrass and rice genomic sequences for glucan water dikinase genes is illustrated. The horizontal axis represents the switchgrass sequence; and the vertical axis represents the rice sequence. Diagonal segments represent regions where the two sequences are highly homologous. This diagram shows the similarity of the switchgrass sequence below to the corresponding sequence of the rice GWD gene.

>switchgrass GWD homologues
[SEQ ID NO: 215]
GGAACGACAGTGTACAAGAACAGGGCTCTTCGGACGCCTTTTCTAAAGGT

CAGTCTTGTTACATTATGGATCTCTTTGTTACCACAGAACAGTCTGGTTA

GCAGTAATGTCCATAACTGTGCAGTCAGGAGGTGATAACTCCACGCTTAG

AATTGAGATAGATGATCCTGCGGTGCAAGCTATTGAATTTCTCATCTTTG

ATGAGACACAGAACAAATGGTAACCCAGCTGTTTTCGTTACCATGTAGCA

CTGTTTGTTTGTTTGAATGCAAAAGGTATATAAACTATGCAAAACTCTAC

ATTGCACAGGTTTAAAAATAATGGCCAGAATTTTCAAATTCAGCTCCAAT

CGAGCCACCATCATGGTAGTGGCGCATCTGGTGCCTCATCTTCTGCTACT

TCTGCCTTGGTGCCAGAGGATCTTGTGCAGATCCAAGCTTACCTACGGTG

GGAAAGAAATGGAAAGCAGTCATACACACCGGAGCAAGAAAAGGAAAGCT

TTTAGTTGTTTTTTTTTATCTTCAGTCTGGAAGGAACTCAATGTACTAAG

TTGATTAAAAATAAGAGGTGGTGTATTTTTTCTCCAGGAGGAGTATGAAG

CTGCACGAGCTGAGTTAATAGAAGAATTAAATAGAGGTGTTTCTTTGGAG

AAGCTTCGAGCTAAATTGACAAAAGCACCTGAAGTGCCCGACTCAGATGA

AAATGATTCTCCTGCATCTCAAATTACTGTTGATAAAATTCCAGAGGACC

TTGTACAAGTCCAGGCTTATATAAGGTGGGAGAAAGCAGGCAAGCCAAAC

TATCCTCCTGAGAAGCAACTGGTAATGCATTGATTCAATAGCGTAAAATA

CCTTGTTGGCTTTACACTTTATGGAGGTTCTTATCTCACAATTCGCTAGG

TCGAGTTTGAGGAAGCAAGGAAGGAACTGCAGGCTGAGGTGGACAAGGGA

ATCTCGATTGATCAGTTGAGGAAGAAGATTTTGAAAGGAAACATTGAGAG

TAAAGTTTCGAAGCAGCTGAAGAATAAGAAGTACTTCTCTGTAGAAAGGA

TTCAGCGCAAAAGAGAGATATCATGCAGATTCTTAGTAAACATAAGCAT

ACTGTCATAGAAGAGCAAGCAGAGGTTGCACCAAAACAACTAACTGTTCT

TGATCTCTTCACCAATTCATTACAGAAGGATGGCTTTGAAGTTCTAAGCA

AAAAACTGTTCAAGTTCGTGATAAACAGATCCTGGTTAGGATCCTTAAG

ATATTCTTTGTATCTCCAGATCTTTTCTACCATGCTAATTAAGCTTCTC

TCTTCTTAAGGCAATCTCCACCAAGGTTCTAAACAAATCAAAAGTTTACT

TGGCAACAAATCATACGGAGCCACTTATCCTTCACTGGTCACTAGCGAAA

AAGGCTGGAGAGTGGAAGGTTAAATTTCAAAATTGTTTCCAGTAGTTAAA

GCCACAAACTCAGCAGCTTTTTTAAACACTGCTATCAGTACCAATGCGGT

GTTATTTAACTGTGCAGGCACCTCCTTCAAACATATTGCCATCTGGTTCA

AAATTGTTAGACATGGCATGCGAAACTGAATTTACTAAGTCTGAATTGGA

TGGTTTGCATTATCAGGTGGAAATAACATCTTCAACCTGTTATTTTATTC

TTATTTTTATTAGCCCTCCTGCTATCTCAAGGCTCTTAATTTCCAGGTTG

TTGAGATAGAGCTTGATGATGGAGGATATAAAGGGATGCCATTCGTTCTT

CGGTCTGGTGAAATGTGGATAAAAAATAATGGCTCTGATTTTTACCTTGA

TCTCAGCACCCGTGATACCAGAAATATTAAGGCAAGTGTTTCTGTCCATT

TTACCTTTCAAACTTTAAACTATTGTCTTTGTTTTGTCTATGCAACTAGT

CGCTAAATTGTGAAGTAACCGATCTGTTCTTAATTGAAGGACACTGGTGA

TGCTGGTAAAGGTACTGCTAAGGCATTGCTGGAAAGAATAGCAGAGCTGG

AGGAAGATGCCCAGCGATCTCTTATGCACAGGTCAGGCACTAAAATATCC

ATAATAATATGACTGAATTTTACATGGAAAATTCTCCTAAACTACTTCTA

CTCCTTGACAGATTCAACATTGCAGCAGATCTAGTTGACCAAGCCAGAGA

TGCTGGACTATTGGGTATTGTTGGACTTTTTGTTTGGATTAGATTCATGG

CTACAAGACAACTGACATGGAATAAGAACTATAATGTGAAGCCACGGTAT

ATACCTGTCTTTATTATTTACTTCAGTAATGTTTACTCTCTGCTTTAAAA

GTTAAAGAATCAGAAGTTGTCCCTTTCTTTTGTGCGGGAACATAATTGAA

AAGTTGGTGTTCTTGCCACTACAAGTCAACGCGATTTTACCCCTCGTCAA

CGGTCAAAACAGTAGCAAAATCGCGTTGACTTGTGAATAGTAAGGGCAAA

TCACAAAGTTGGAAAAAACAAGGACAAAATCACAATTGCACTGCAAAGTA

GTCGCGGAAACACAAATGCCCCAAAATAATTTGGCTGTTTGTCCTGATAA

AAAACAATACAATTCAGTACTCAGAGAATATTATATTTCTATAAATGAAA

AACATAACTCATGTCGCATTCTTTCATTCTTTGGCATCTCATATTGATTA

ATAACTACGCAGTGAGATAAGCAAAGCACAAGATAGGTTTACAGATGATC

TTGAGAACATGTACAAAGCTTATCCTCAGTACGAGAGATATTAAGAATG

ATAATGGCTGCTGTTGGTCGTGGAGGTGAAGGTGATGTTGGTCAACGTAT

TCGTGATGAGATATTAGTAATACAGGTAAAATTAATGGTCCTAGGTGAAT

ATACACCTACTTTTATTCATTGCTTCACTGAATTATACGGTTGGTAGTTC

TGATCCAAAAGATAGACATTGTGAATAATAATAAAATGCTTGCTGCTTTT

ATAGAGAAATAATGACTGCAAAGGTGGAATGATGGAAGAATGGCACCAGA

AATTGCACAACAATACAAGCCCAGATGATGTAGTGATATGCCAGGTATTG

GATATTTTGAATTCTTAATACTGTAAGTATTTAAGCATTGAGGTTTTTAT

GGTTATGTCTCTCCTTGGGCAGGCATTAATTGATTATATCAAGAGTGATT

TTGATATAAGTGTTTACTGGGACACCTTGAACAAAAATGGCATAACCAAA

GAGCATCTCTTGAGCTATGATCGTGCGATTCATTCAGAACCAAATTTCAG

AAGTGAACAGAAGGAGGGTTTACTCCATGACCTGGGTAATTACATGAGAA

GCCTGAAGGTATGTAAAACACTTAATATGGATATAAAAAAAGGCATGCAA

AAAAATCTGTGCATTATCTTTGAAATTGAGTATGGTATTTTCTAAAGAAA

ACATAGAAAACACATATTGCCCTTTCAGTTCCGGAAAAAAATGATCTGC

CATAAAGAGCATACAGTCAACTCATGTATTAGCACTCGCCTTTTCTGCTA

ATGGTATGTTGTGTTGTGTTCTGTTCTATTCAATATATGCTTTCAGTAAT

AATATTCTAGTGTTGACAACATCATTGCTCACAACATACAGAAACTGTAG

TATGCCCGGTACAGTATGAACTTGTCCTTGAGTCTCCTCATTTTTTCCTT

ATTCACGTCACAGCTTTATATCCTTCCAATGAATAATGATCAACTTGGAA

ATCATTGGCATCTACAGTGAACCGTCCATTGTATTCTGATTTTGAACAAC

TTTTTTTCCCCTCAGAACACACAGTAATAGCCAAGTATAACGACCTTACA

TGGCCAAAACAACAACCTTACATGGCCAAAATAGCCAGGTAAGGGACAGA

```
AGAAGAGAGAGGGTTGCCCTGCGGCAGATGTGGACAATGACTGATGATGT
GGCTGTCCCAGTTATCAAAACAGGCAAATCCACTGTTCATGTGGCCNAAG
CCAGTAATGAGCTGGTTTTGGGAAACCCTGGGGGATTGAGTAAACAATTA
GAGGGTTATGTGGATTTGGTCATAGTTGGGGGTAGGAATTTGGAAATTTC
CCTTTTGCTTGATAATTATGTTAGTCAAGAGATTAGACAAGTATTGTTAG
GAGTTTGTTTCAGCTGGTTGAGATTGGATTTGGTTTCTTAGGTGATTGGT
TAGTGCTACCCTTGCTCTATAATTGGGGATTTGCTTTTAATAAAGAAAGC
AGAAATAAACCCAATCCTTCTCCGGTTCTCCCTCTTTTGTCCGATGTTTG
CAGATGCGGCCACTGATAAGGTCCAGGTCCATGTCCTCCCATCAACCACA
CACACATACAGCCTAAGATCTAATTCACCCCAGGACACCCAAGCTCGTGA
AAATATACCATGTCATCCCACTATTCATACTTTTTTTAAAAAAATCCCAC
TAATCCTGCAAATGTCCTAATATAAGAACAACATCATTTTCAGTCATGTT
GTACCTTTTCTTGGTGACAAAAAGAAGACATCCATTTCATCTCTTTTTAA
GGGGCATTTTCTCATCGTTTCTGCAATTGAATATTCTTTCCCTGATGTAA
TCTTTGAATGAATGCTATTGTGATTTGCTCATTCTGTTAGGCTGTGCATT
CTGGTGCTGATCTTGAGTCTGCTATAGCAACTTGCATGGGATACAAATCG
GAGGTATCATTCTCATTCCTTTTCATTCCGCTAGAATTCTTTAGATACCT
GTGCTCATATCTAATGAACTAACTTTTGGGTACAGGGTGAAGGTTTCATG
GTCGGTGTTCAGATCAATCCAGTGAAGGGTTTGCCATCTGGATTTCCTGT
AAAAATCCCTCACCTTCTTTTCTCAACACATGTACTTTCTAAGTTTCTTA
TACTTGTGACATTTACCTTTATAGGAATTGCTCAAATTTGTGCTTGACCA
TGTTGAGGACAAGTCAGCGGAACCACTTCTTGAGGTCAGTGATATAATCG
AAGTTCCTGTTTGTAATAAAACGAAGAGAAGAAGCTGGGTTTTTCATCAC
AACTCAAATAATCAGATCTCACATAGCTGATTGAATTTTTAAACCACCAT
TTTTTGCGGNTACTATGNGAATCACTTGTTGCTAACAAAATGCTACCTTG
NAGGGGNNGGTGGAAGCTCNAGTTGAACTCCNCCCTNNNCTTCNTGNTTC
ACCNGNACGCATGAAAGAANNTATTTTTTTGGNCATTGCNCCTGATTCNA
CTTTTANGACAGCTATNGAAAGGNCATATGANGAGCTCCNCCATGGANNC
CCCGANGNTGGGCNCCCNAATATTGNCCCCATGATNNGNNNNNANGNNNAG
NNCCNNNANNNNNNNCNNNNNNNNNNNTNNNNNANANNNNGNNTNNNNNAN
NNNNNNNNNNNNNGNNNNNNNNCNNNNNNNNNNNNNNNNNNNNNNNNNNN
NNAANNNNNNNNNNNNNANNNCNNNNNNNNNNNNNNNNANNNNNNNNA
NNNNNNNNNNNNNNNNNCNNNNNAANNNNNNNNNATNCNNNNNNNNNN
NNNNNNNNNNNNNNNNNANNNNNNNNNNNNNNNNCNNCNNNNNNNNNN
NNNTNNNNNNNNANNNNCAACNNNNNNNNNNNNNNNNNCCNNNNNNNN
NGNNNNNNNNNNNNANNNNNNNNNNNNNNANNNNNNNANNNNNNNN
NNNNNNNNNNNANNNNNNNNNNNNNNNNNNNNNNNNNNNNNNNNNN
NNNNNNNNNNNNNNNNNNNNNNNNNNNNNNNNNNNNNNNNNNNNNN
NNNNNNNNNNCCNNNNNNNNNNNNNNNNNNNNNANNNNNNNNNNNNN
GNNNNNNNNNNNNNNNNNNNNNNNNNNNNCNNNNNNNNNNNNNNNNCN
NNNNNNNNNNNNNANNNNNNNNNNNNNANNNNNNNNNNNNNNNNNNN
NNNNNNNNNNNNNNNNNNNNNNNNNNNNNANNNNNNNNNNNNNTNNANN
NCNNNNNANTANNCNNNNNNNNNTNNNNGNNNNNNNNNNNNNNNNNNN
NNNNGANNNNNNNNNNNNNNNAGNNNTNNNANNNNNCNNNNNNNNNNGN
NNTNNNNNNNNNNNNNGNNNNNNNNNNNNNNNNNNNNNNNNTNNNNNNNN
NNNNNNNNNGNNNNNNNTNNNNNNNNGNNNNNNNNCNNNNNNNNNNNNNN
NNNNNNNNNNNNNTNACNNNNNNNNNNNNNTCNCNNNNNNNNNNNNNNN
NNNNNNNNNNNNNNNNNGGCNTNNNNNNNNNNNNNNNNNNNNNNNNNN
NNNNNNNNNANNNNNCNNNNNNNNNNNCNNNNNNNNNNNNTNNNNNNCNNN
NNCNNNNNNNNNNNNNNNNNNNNNNNNNNNNNNNNNNTGNNNNNNCNN
NNNNNNNNNNNCANNNCNNNNGNAGATCTCGGAGAGTGAACTTCAGCAATC
AAGTTCTCCGGATGCAGAAGCTGGCCATGCAGTACCATCTATTTCATTGG
TCAATAAGAAGTTTCTTGGAAAATATGCAATATCAGCTGAAGAATTCTCT
GAGGAAATGGTTAGTAATATAAAATTTTGCATTAGGAAATCTGCCATTCG
TAAGGAAGTCTTGATGAAACCAATTGTTATTATGCTGGTTTCCTTTTCTT
TTGGCCTTGTGCTTCTAGTACTCACTTTTATGTTTTCAGGTTGGGGCTAA
GTCTCGGAATATAGCATACCTCAAAGGAAAAGTACCTTCGTGGGTTGGTG
TCCCAACATCAGTTGCGATACCATTTGGCACTTTTGAGAAGGTTTTATCA
GATGGGCTTAATAAGGTTGGTTGGTGGTTTATTTTGATGTATATACTTGA
ATAATAGAACTGCATGGTTCTTGGAGAAGTCAGATTCTTTAACATGTTTG
AAATACACTACTGGGAAGGTAACAACGTGCAATTTAATGTCCACCAATAT
CTAAACAGCCATTTTTGGCATTCAATTCACTATATATTTTATTTCATGAG
CCTGCTCTATAAGTAGCGTCTTCAGTAGTTGTAGCTCATAGCTTCATAGT
CTCATTCTACCATGAACTAATTTTGCTAACTTACATCTACTCTTGAAATA
AGTAATACTTGTATATTATTATCTTTGATTGTAAAAGAACTTCCCTTGCT
CGTTTGTCAAGGTGTCTTTTAGACAGGAGATGGAATTGACTGTTATCAAA
GCAAATGATAACAAGAAACCTCTTGTTGATTGGTTGAGCAGTTTCAACTA
ATCCATTTTTTTTTCTTTTTGGCATGTGATCTTTGTATTATTGGCCCAAA
TGAAATTCTATTTCTCCCATTAACCACCCACAATGGCAGGTTTGGGTACA
TATAGGCCAACCATGGGTAGGTGGCTTAAAAGTTGAGTAAAGCATAATTG
GGGATAAGGTGCACATAGGCACGGACCACCCACAGACAAAGTGCTTGCAG
GCACTACTAATACATTATTCTATCACCATCAGGATTCAATTCTAACATGT
ACTGTTTCTTCTTTTTCTTCTTTGTACAGTTCCTGTATAGACCCTTTTGT
ACAGTTTCCTAACAAATGAAAAAGATCAGTAGGAGACCCTCTTCTCCTGT
TCCACAAAAAATGTTAAAATGGTCTTTCTAATATTTGATTGTTCTTTCTT
TTATGGCAGGAAGAGCGCAAAACATAGAAAGCTT
```

Example 7

Cloning ZmGWD1RNAi and ZmGWD2RNAi Silencing Cassettes

The gene-specific inverted repeats within silencing cassettes ZmGWD1 and ZmGWD2 in the initial vectors pAG4102 and pAG4103 were selected in two independent regions of the maize ZmGWD cDNA (Maize GDB, Accession No. GRMZM2G412611). The 497 bp ZmGWD1 repeat sequence, which was used in construction of the pAG4102 vector, corresponds to position 389-885 nt at 5' end of the predicted maize GWD cDNA. The ZmGWD1 has two nucleotide mismatches (positions 449 and 483) comparing to the ZmGWD cDNA, which derived from the expressed sequence tag (EST) assembly TC458260 (The Gene Index Database) representing maize GWD expressed sequence.

Prior to pAG4102 and pAG4103 vector construction, both ZmGWD1 and ZmGWD2 sequences were checked for potential intron splicing sites with only one such site identified in ZmGWD1 (AAAGGAGGAGT: SEQ ID NO: 152). This sequence was left intact for pAG4102 vector construction.

The spacer region ZmAdh1i6 in ZmGWD1RNAi and ZmGWD2RNAi silencing cassettes (corresponding vectors pAG4102 and pAG4103) represents 342 bp sequence of the

```
ZmGWD1
                                                        (SEQ ID NO: 49)
TCCTCCCGTC CAGAAAACCT GATGGAACGA CAGTGTACAA GAACAGGGCT CTCAGGACAC    60

CTTTTGTAAA GTCAGGTGAT AACTCCACTC TAAGGATTGA GATAGATGAT CCTGGGGTGC   120

ACGCCATTGA GTTCCTCATC TTTGACGAGA CACAGAACAA ATGGTTTAAA AACAATGGCC   180

AGAATTTTCA GGTTCAGTTC CAGTCGAGCC GCCATCAGGG TACTGGTGCA TCTGGTGCCT   240

CCTCTTCTGC TACTTCTACC TTGGTGCCAG AGGATCTTGT GCAGATCCAA GCTTACCTTC   300

GGTGGGAAAG AAGGGGAAAG CAGTCATACA CACCAGAGCA AGAAAAGGAG GAGTATGAAG   360

CTGCACGAGC TGAGTTAATA GAGGAAGTAA ACAGAGGTGT TTCTTTAGAG AAGCTTCGAG   420

CTAAATTGAC AAAAGCACCT GAAGCACCCG AGTCGGATGA AAGTAAATCT TCTGCATCTC   480

GAGTGCCCAT CGGTAAA                                                 497
```

The 540 bp ZmGWD2 repeat sequence, which was used in construction of the pAG4103 vector, corresponds to position 2986-3525 nt of the predicted maize GWD cDNA. The ZmGWD2 sequence spans over a nucleotide triplet encoding Hys1072 that has been proposed to be a crucial amino acid residue in phosphorylation activity of the GWD protein (Mikkelsen, 2004).

predicted intron 6 of the maize Adh1 gene (Gene Bank Accession No. X04049). This intronic sequence was cloned into silencing cassettes with its native gene coding flanking sequences consisting of either of 11 bp at 5' end or 10 bp at 3' end of the intron. The flanking sequences were included to ensure efficient post-transcriptional intron splicing. The flanking sequences are shown in capital letters in ZmAdh1i6.

```
ZmGWD2
                                                        (SEQ ID NO: 50)
CTTCTGAACC GATTTGATCC TGTTTTAAGG AATGTTGCTC ACCTCGGAAG TTGGCAGGTT    60

ATAAGCCCGG TTGAAGTATC AGGTTATGTG GTTGTGGTTG ATGAGTTACT TGCTGTCCAG   120

AACAAATCTT ATGATAAACC AACCATCCTT GTGGCAAAGA GTGTCAAGGG AGAGGAAGAA   180

ATACCAGATG GAGTAGTTGG TGTAATTACA CCTGATATGC CAGATGTTCT GTCTCATGTG   240

TCAGTCCGAG CAAGGAATAG CAAGGTACTG TTTGCGACCT GTTTTGACCA CACCACTCTA   300

TCTGAACTTG AAGGATATGA TCAGAAACTG TTTTCCTTCA AGCCTACTTC TGCAGATATA   360

ACCTATAGGG AGATCACAGA GAGTGAACTT CAGCAATCAA GTTCTCCAAA TGCAGAAGTT   420

GGCCATGCAG TACCATCTAT TTCATTGGCC AAGAAGAAAT TTCTTGGAAA ATATGCAATA   480

TCAGCCGAAG AATTCTCTGA GGAAATGGTT GGGGCCAAGT CTCGGAATAT AGCATACCTC   540
```

```
            ZmAdh1i6
                                                                (SEQ ID NO: 51)
            ATTCGAAGAA Ggtacagtac acacacatgt atatatgtat gatgtatccc ttcgatcgaa    60
ggcatgcctt ggtataatca ctgagtagtc attttattac tttgttttga caagtcagta   120
gttcatccat ttgtcccatt ttttcagctt ggaagtttgg ttgcactggc acttggtcta   180
ataactgagt agtcatttta ttacgttgtt tcgacaagtc agtagctcat ccatctgtcc   240
```

```
cattttttca gctaggaagt ttggttgcac tggccttgga ctaataactg attagtcatt    300
ttattacatt gtttcgacaa gtcagtagct catccatctg tcccattttt cagCTAGGAA    360

GTT                                                                  363
```

The parts of the ZmGWD1RNAi and ZmGWD2RNAi silencing cassettes containing inverted repeats with the spacer sequence ZmAdh1i6, were synthesized as BamHI-AvrII fragments by the GenScript CRO. The synthesized fragments were cloned between maize PepC promoter and *Agrobacterium tumefaciens* nopaline synthase (NOS) gene terminator sequences to produce pAG4102 and pAG4103 silencing vectors.

Both ZmGWD1RNAi and ZmGWD2RNAi cassettes were subsequently used for generating more complex stacked vectors by cloning silencing cassettes into T-DNA regions of the vectors that already had various expression cassettes for production of the cell wall degrading enzymes (CWDEs).

Example 8

Generation of Transgenic Plants

*E. coli* strains carrying pAG2104, pAG2105, pAG2100, pAG2101, pAG2102, pAG2103, pAG2104, pAG2106, pAG4003, pAG4102, pAG4103 or plasmid-based transformation vectors carrying constructs 2379, 2380, 4106, 4107, 4108, 4109, 4110, 4111, 4112, 4113, 4114, 4115, 4116, 4117, 4120, 4121, 4124, 4125, 4514 or 4515 were used for conjugation with *Agrobacterium* and subsequent transformation of rice, maize, sorghum and switchgrass.

Example 9

Suppression of mRNAs from Genes Involved in Mobilizing Vegetative Starch

Figure 13:
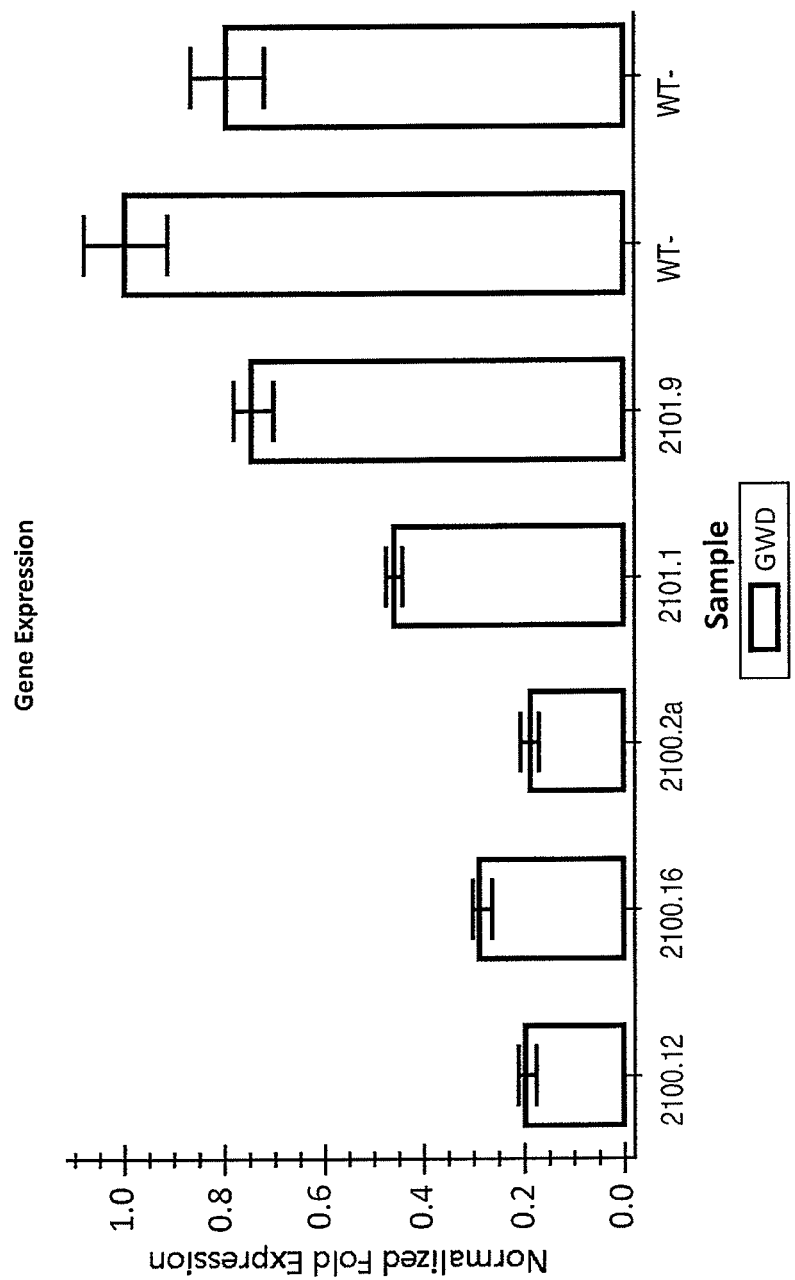
FIG. 13 illustrates GWD mRNA levels among plants carrying either pAG2100 or pAG2101, and wild type (WT) control plants.
Figure 14:
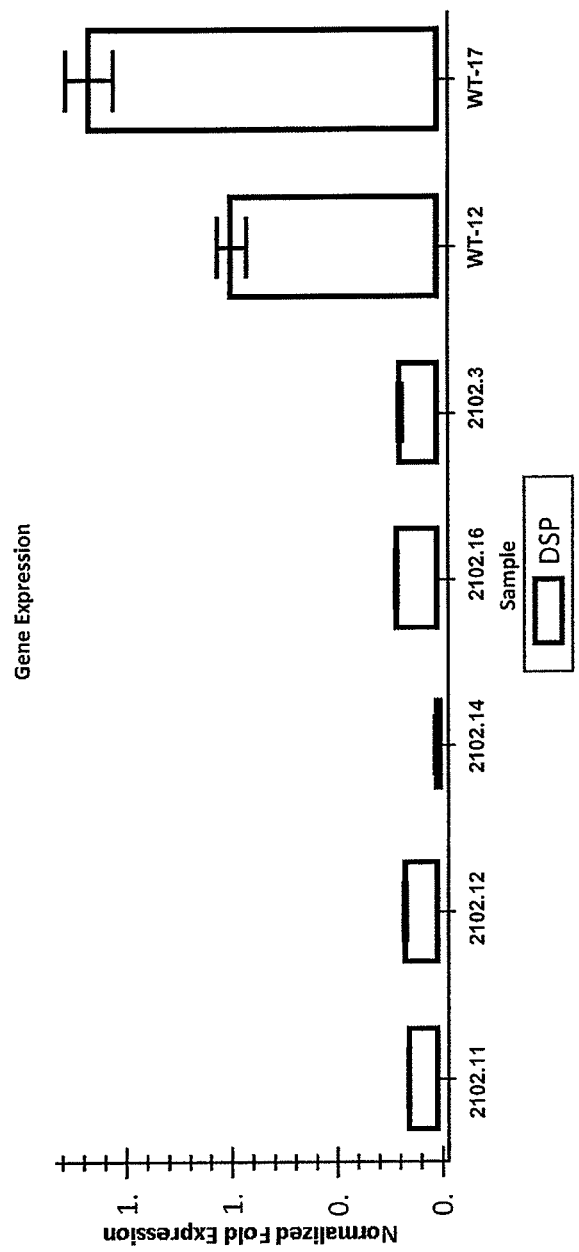
FIG. 14 illustrates DSP mRNA levels among plants carrying pAG2102 and WT controls.
Figure 15:
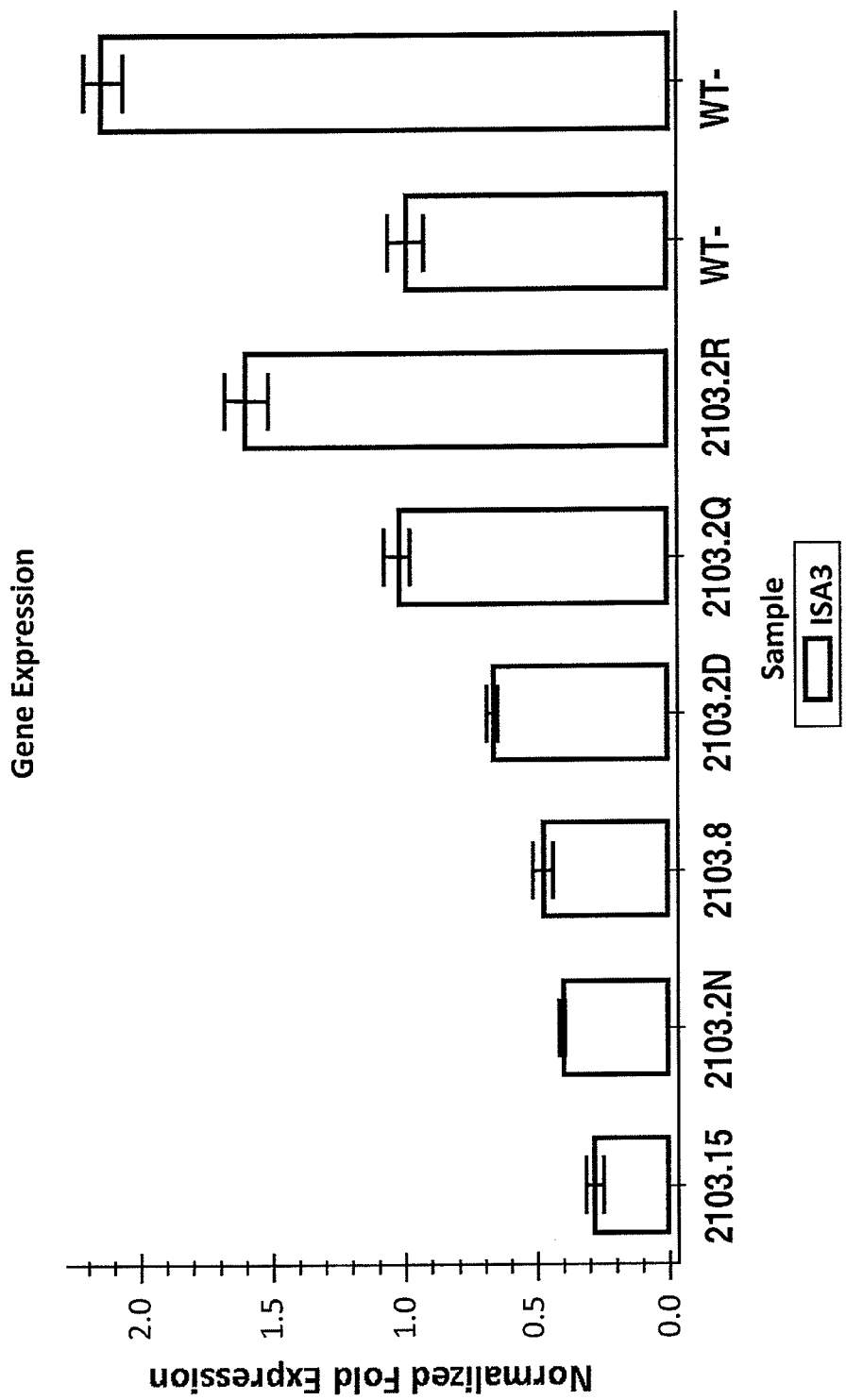
FIG. 15 illustrates ISA3 mRNA levels among plants carrying pAG2103 and WT control plants.

To determine whether the RNAi vectors described above were exerting an effect on targeted mRNAs in transgenic plants, RNA was isolated from several control and transgenic plants, and real time reverse transcriptase PCR (real time RT-PCR, also known as real time quantitative PCR, RT-qPCR) was used to measure the relative abundances of mRNA species (FIGS. 13, 14, and 15). These results confirmed that RNAi can be used to lower the level of native mRNAs in transgenic rice.

Referring to FIGS. 13, 14, and 15, these figures illustrate that RNAi vectors suppress the accumulation of targeted mRNAs in transgenic rice. Real time RT-PCR was employed to measure the abundance of different species of mRNA relative to that of reference genes ("housekeeping genes") that are nominally constitutively expressed in rice). In several of the transgenic lines, levels of the targeted mRNAs were found to be well below those seen among control plants. FIG. 13, GWD mRNA levels among plants carrying wither pAG2100 or pAG2101 and wild type (WT) controls; FIG. 14, DSP mRNA levels among plants carrying pAG2102 and WT controls; FIG. 15, ISA3 mRNA levels among plants carrying pAG2103 and WT controls.

The efficiency of GWD gene silencing in transgenic maize plants transformed with either pAG4102 or pAG4103 silencing constructs was similarly assessed by RT-qPCR. Green leaf material of transgenic and untransformed maize plants was sampled at the dusk, when the highest expression levels of the GWD gene is observed in monocots (Agrivida unpublished data). Collected leaf material was immediately frozen in liquid nitrogen and transferred to a −80° C. freezer for the storage prior to RNA isolation. The total RNA isolation was performed from 0.1-0.2 g of the frozen maize leaf tissues using TRIZol reagent (Invitrogen) according to the instructions supplied by the manufacturer with minor modifications. In order to remove any residual amounts of the maize genomic DNA in RNA preparations, 10 micrograms of the total RNA that was extracted with TRIZol from each sample were subsequently digested with DNase using the TURBO DNA-free Kit (Applied Biosystems/Ambion). The DNase-treated RNA samples were further purified with the RNeasy MinElute Cleanup Kit (QIAGEN) and 1 microgram of the purified RNA was subjected to cDNA synthesis using iScript Reverse Transcriptase (Bio-Rad) as described in the protocol provided by the manufacturer. All cDNA samples were diluted 1:50 with nuclease-free water. One microliter of the diluted cDNA sample (equivalent to 1 ng of the total RNA that was used for cDNA synthesis) was subjected to the qPCR assay with iQ SYBR Green Supermix (Bio-Rad) as specified in the supplied protocol. The GWD gene expression in plants that were evaluated was normalized against expression of two internal maize reference genes such as beta-Actin (GenBank Accession No. U60508) and glyceraldehyde-3-phosphate-dehydrogenase (GADPH, GenBank Accession No. X07156.1). The primers utilized in RT-qPCR analysis were designed with Primer3 software that is available online. The PCR primers are listed in Table 3:

TABLE 3

List of the primers used in RT-qPCR for analysis of maize GWD expression

| Target gene | Forward primer | Reverse primer | Annealing temperature (° C.) | Product size, bp |
|---|---|---|---|---|
| GWD | ob1659 (SEQ ID NO: 153): ATGAAGGAGACAAGCGTTGG | ob1660 (SEQ ID NO: 154): AAGTTTCACCTTGCGTGTGC | 55 | 104 |
| Beta-Actin | ob1555 (SEQ ID NO: 155): CAACTGCCCAGCAATGTATGC | ob1556 (SEQ ID NO: 156): GTAGATAGGGACGGTGTGG | 55 | 119 |

TABLE 3-continued

List of the primers used in RT-qPCR for analysis of maize GWD expression

| Target gene | Forward primer | Reverse primer | Annealing temperature (° C.) | Product size, bp |
|---|---|---|---|---|
| GADPH | ob1567 (SEQ ID NO: 157): CGCTGAGTATGTCGTGGAGTAA | ob1568 (SEQ ID NO: 158): CAACCTTCTTGGCACCAC | 55 | 88 |

All PCR primers for GWD expression assays had been previously validated through regular RT-PCR followed by the agarose gel electrophoresis in order to check primer specificity. Furthermore, selected primers were validated by the Standard Curve Calibration and Melt Point analyses to ensure reproducible amplification results. Real-time PCR amplification reactions were performed in 12.5 microliter volume in 96-well plates in a CFX-96 instrument (Bio-Rad). A control cDNA representing untransformed plant #37 (wild type maize line A×B) was run with each experimental plate to ensure availability of a cross-reference between different qPCR runs. A no-template control (NTC) was also included with each run for every gene. Each experimental sample was run in triplicates. The thermal profile of the PCR reaction was 95° C. for 3 min activation and denaturation, followed by 40 cycles of 95° C. for 10 sec, 55° C. for 20 sec, and 72° C. for 30 sec. The quantification cycle value (Cq) for each reaction was calculated automatically by the CFX Manager Software (Version 2.1). The observed expression of the GWD gene in untransformed control plant #37 was set to "1" and GWD expression in each analyzed transgenic plant was compared to this value in order to generate relative gene expression data.

Results of the GWD Expression Analysis in Transgenic Maize

Figure 16:
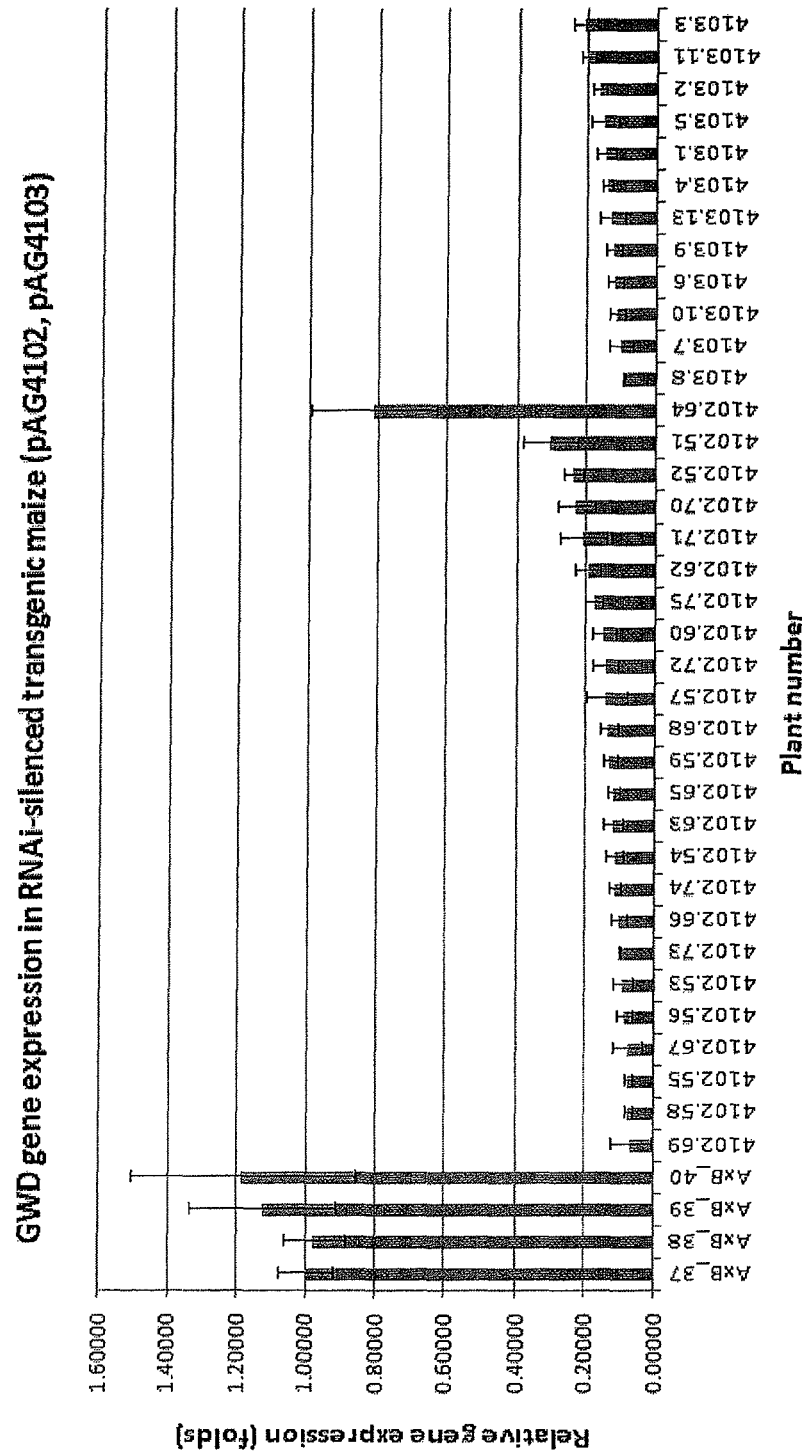
FIG. 16 illustrates expression of the GDW gene in the RNAi-silenced transgenic maize produced from constructs pAG4102 and pAG4103.

The silencing cassettes ZmGWD1RNAi and ZmGWD2RNAi provided significant levels of suppression of the GWD gene expression reaching more than 13 fold transcript level reduction in individual transgenic plants, when compared to the untransformed maize plant #37. The GWD gene expression was not suppressed in only one plant (4102.64) among all analyzed transgenic plants. The observed GWD silencing efficiency was 95.8-100%, with more than 3 fold transcript level reduction in each analyzed transgenic plant relative to the GWD level in untransformed maize (Table 4 and FIG. 16).

TABLE 4

Efficiency of GWD silencing in transgenic maize by ZmGWD1RNAi and ZmGWD2RNAi cassettes

| Silencing cassette | Number of analyzed transgenic plants | Number of plants with suppressed GWD transcript levels | The observed efficiency of GWD silencing (% of silenced plants) |
|---|---|---|---|
| ZmGWD1RNAi (pAG4102) | 24 | 23 | 95.8 |
| ZmGWD2RNAi (pAG4103) | 12 | 12 | 100 |

Example 10

Modified Plants Accumulate Elevated Levels of Starch and Higher Overall Glucose

Figures 17A, 17B:
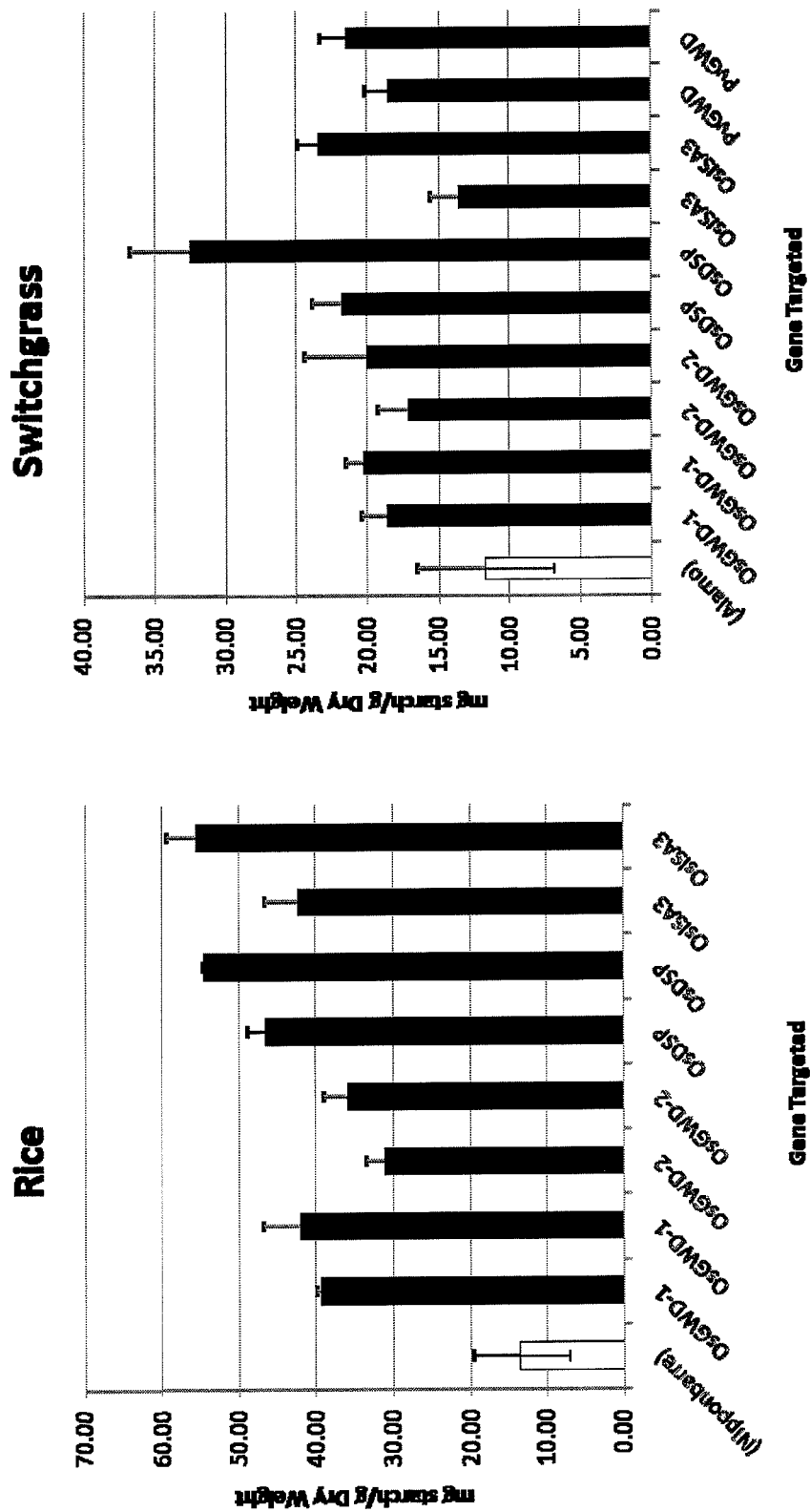
FIGS. 17A-B illustrate elevated starch among select lines of rice (17A) and switchgrass (17B) that carry RNAi constructs.

Tissues were collected from control plants as well as rice and switchgrass plants that carry integrated copies of the RNAi transgenes described above. These tissues were then dried and milled to a fine powder. The starch content of these tissues was then determined by standard methods (Smith A M and Zeeman S C, Quantification of starch in plant tissues (2006) Nat. Protocols 1:1342-1345, which is incorporated herein by reference as if fully set forth). Referring to FIG. 17, elevated starch among select lines of rice and switchgrass is shown for those lines that carry RNAi constructs. Results from Nipponbarre and Alamo (untransformed control lines for rice and switchgrass, respectively) represent the averages from several different plants. Other results represent 2-3 fold replicate data from single transgenic plants. Transgenic plants are identified according to the starch mobilization gene targeted. OsGWD-1 plants carry the RNAi vector pAG2100; OsGWD-2 plants carry pAG2101; OsDSP plants carry pAG2102; OsISA3 plants carry pAG2103; PvGWD plants carry pAG2104, an RNAi expression vector that specifically targets switchgrass GWD transcripts resembling the sequences described above (see FIG. 12). As shown in FIG. 17, several transgenic lines of rice and switchgrass were identified that accumulate starch above the levels seen among control plants. In these examples, starch accumulated to levels as high as 6% among transgenic rice lines while only accumulating to about 3% in the highest of the control lines. In switchgrass, the highest Alamo line accumulated about 2% starch whereas the highest transgenic line accumulated about 3.5% starch by dry weight.

Figure 18:
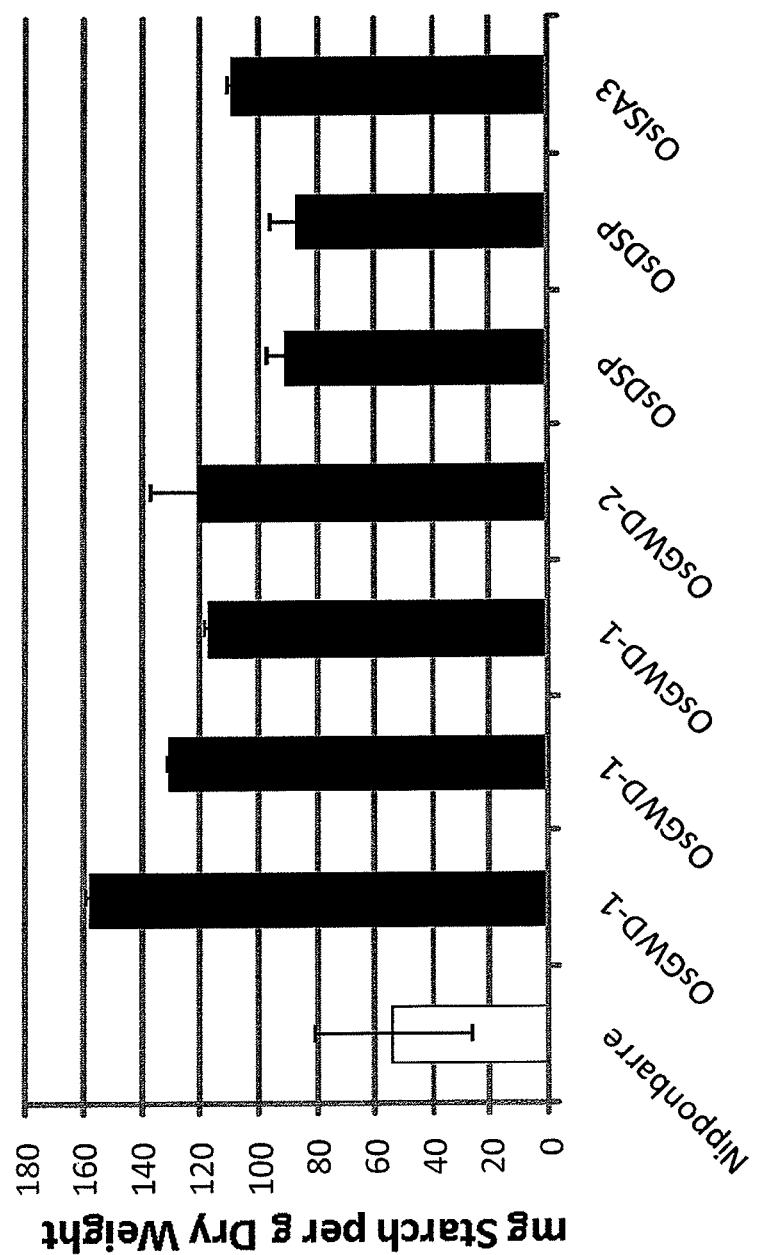
FIG. 18 illustrates starch content in transgenic rice lines, collected approximately 19 weeks after planting.

Referring to FIG. 18, starch content in several rice plants approximately 5 weeks older than those depicted in FIG. 17 was found to be 2 to 3 times than that observed in younger plants. FIG. 18 illustrates starch content in transgenic rice lines, collected approximately 19 weeks after planting. Nomenclature of plants is as in FIG. 17. Among these, one line expressing an RNAi that targets GWD accumulated starch to ~16% dry weight, while control lines accumulated no more than ~8% starch.

To generate additional transgenic plants that express the above-described microRNAs or hpRNAs, constructs were introduced into plasmid vectors for *Agrobacterium*-mediated plant transformation pAG2005 (SEQ ID NO: 75), and pAG4003 (SEQ ID NO: 76).

Figure 19:
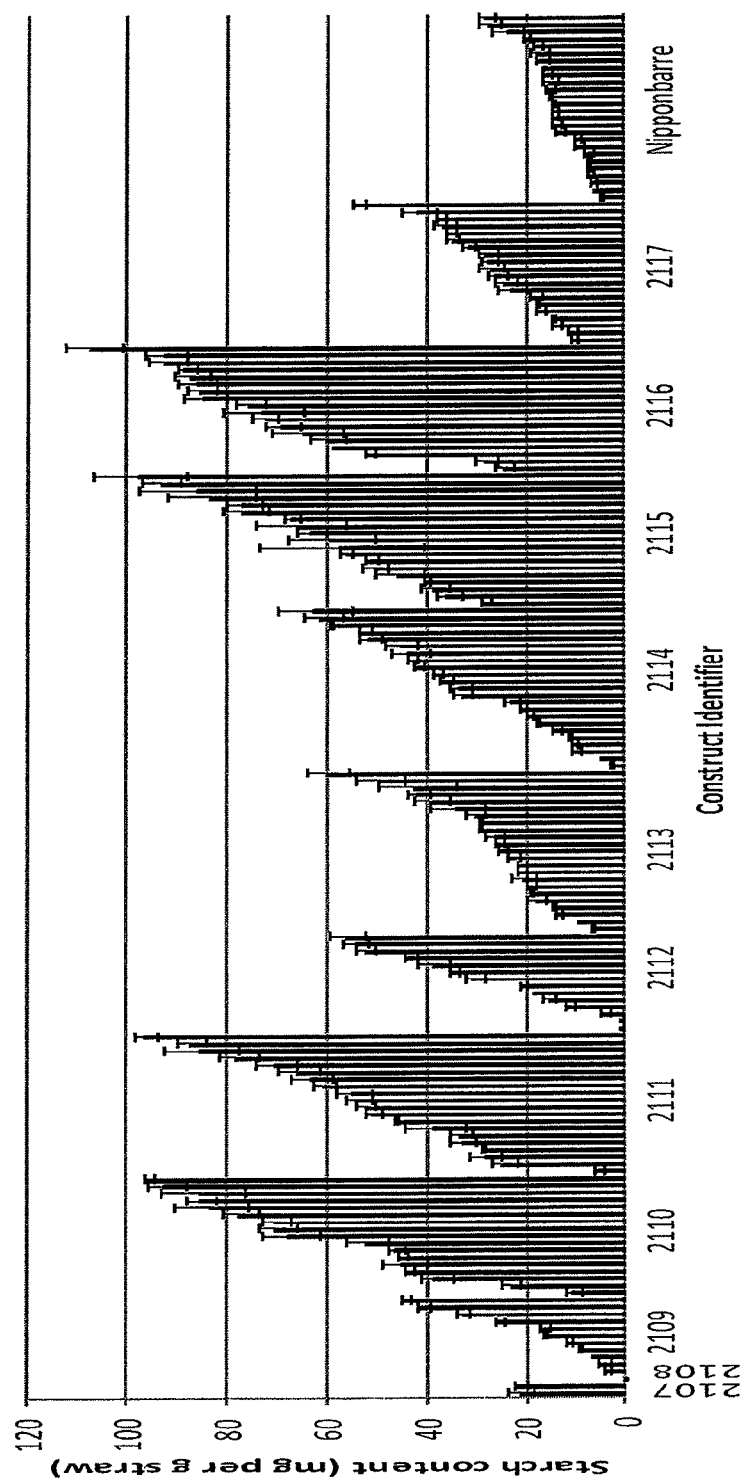
FIG. 19 illustrates a chart depicting starch content (mg starch per gram straw dry weight) across populations of transgenic rice plants each carrying one of 11 different constructs numbered sequentially 2107 to 2117. Nipponbarre are untransformed control rice lines.

Transgenic rice plants were generated, and grown in greenhouses to maturity, after which seed and dried straw were harvested. The starch content of individual plants was measured via a total starch assay (Megazyme, Bray, County Wicklow, Ireland). FIG. 19 illustrates the starch content that was observed among several individuals from populations carrying each of 11 different constructs, wherein the constructs correspond to SEQ IDs as follows: 2107 (SEQ ID NO: 59), 2108 (SEQ ID NO: 60), 2109 (SEQ ID NO: 61), 2110 (SEQ ID NO: SEQ ID NO: 63), 2111 (SEQ ID NO: 64), 2112 (SEQ ID NO: 66), 2113 (SEQ ID NO: 62), 2114 (SEQ ID NO: 65), 2115 (SEQ ID NO: 72), 2116 (SEQ ID NO: 73), and 2117 (SEQ ID NO: 74). These results indicate that suppressing expression of enzymes, such as GWD, PWD, and DSP, that are involved in the turnover of transitory starch cause plants to accumulate starch and that this starch can persist in the biomass after senescence.

Milled samples of the straw were collected from each of several transgenic plants produced from pAG2110, pAG2115, and pAG2116 that accumulate >8% (>80 mg/g) starch, and these were pooled to prepare a "transgenic mix." This transgenic mix had an average total starch content of approximately 9.2% (92 mg starch per gram dry weight). Similarly, samples of straw from Nipponbarre plants were pooled to prepare a "NB control mix," which had an approximate starch content of 0.8% (8 mg starch per gram dry weight). Samples were then taken from these mixes, and total acid hydrolysis was used to examine their total carbohydrate composition to determine whether starch accumulation affected overall carbohydrate content. About 0.20 g milled tissue from each mix was treated with 72% sulfuric acid at 30° C. for 1 hr. The acid was then diluted to 4% concentration, and samples were autoclaved at 121° C. for 1 hr. After cooling, the pH of the samples was adjusted to pH 5-8. Analysis was carried out via HPLC, and sugar concentrations were calculated relative to pure sugar standards. Results from this analysis are shown in Table 5.

TABLE 5

Carbohydrate composition of control and transgenic rice straw.

| Carbohydrate | NB control mix | | Transgenic mix | |
| --- | --- | --- | --- | --- |
| | Ave | Stdev | Ave | Stdev |
| Glucose (g/100 g biomass) | 36.32 | 0.07 | 43.39 | 0.39 |
| Xylose (g/100 g biomass) | 14.64 | 0.09 | 13.84 | 0.06 |
| Galactose (g/100 g biomass) | 1.26 | 0.09 | 0.91 | 0.53 |
| Arabinose(g/100 g biomass) | 0.25 | 0.02 | 0.07 | 0.24 |
| Mannose (g/100 g biomass) | 2.16 | 0.06 | 2.01 | 0.45 |

These results confirm that the additional starch content of the transgenic biomass results in an increase in the total glucose content of the material and does not come at the expense of, for example, cellulose-derived glucose.

Example 11

Figure 20:
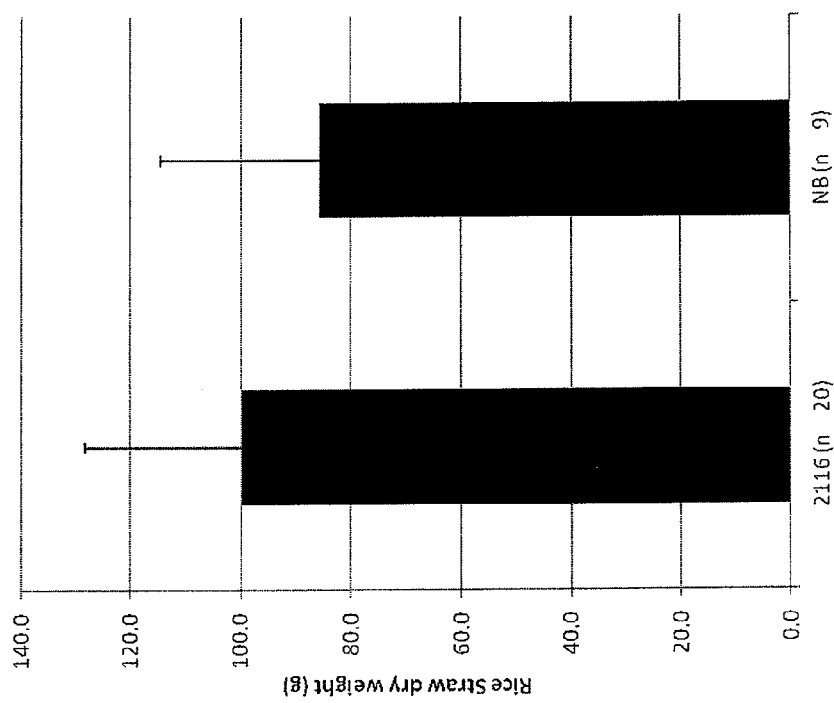
FIG. 20 illustrates the dry weight of transgenic rice plants carrying 2116 construct and untransformed control rice plants (NB).

Transgenic Plants that Accumulate Vegetative Starch have Greater Above-Ground Biomass To determine whether the starch-accumulation phenotype affected the biomass yield among transgenic plants, 20 progeny from a single rice plant carrying construct 2116 and 9 progeny from wild type (NB) control plants were grown in a greenhouse to maturity, seed was collected, and total above ground biomass (excluding seeds and panicles) was harvested, dried and weighed (FIG. 20). Referring to FIG. 20, the average dry weights of the plants from the 2116 population is 17% greater than that of the control population.

Example 12

Glucose Recovery Following Enzymatic Hydrolysis

Figure 21:
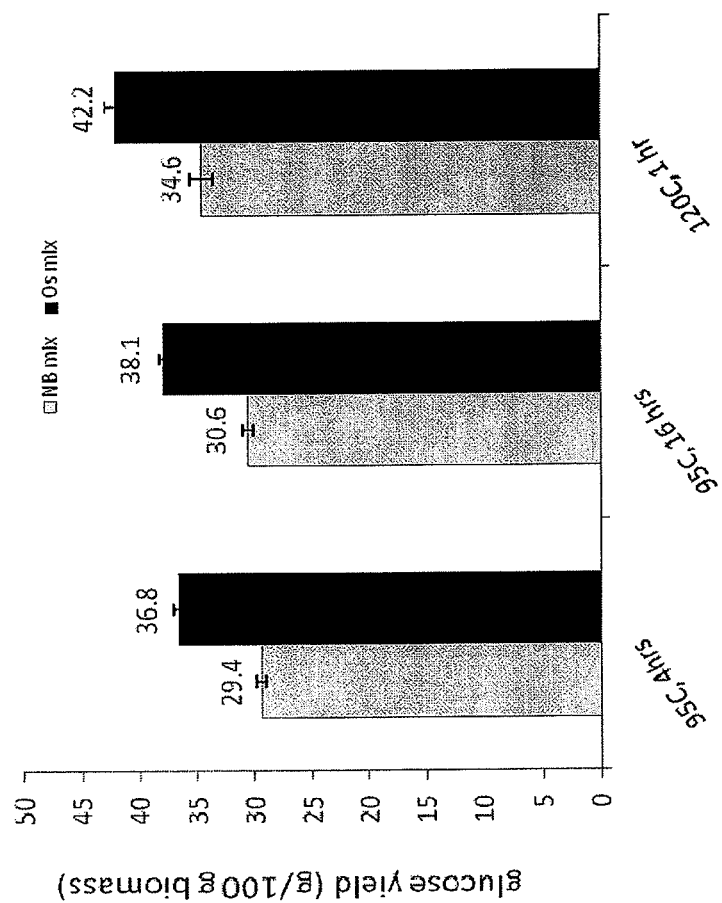
FIG. 21 illustrates glucose yield from transgenic (Os mix; black bars) rice straw produced by using constructs pAG2110, pAG2115 and pAG2116 and non-transgenic control NB mix (non-transgenic Nipponbarre rice; gray bars) following pretreatment with 0.25M sulfuric acid (acid) at 95° C. for 4 or 16 hours or at 120° C. for 1 hour and enzymatic hydrolysis.

Rather than using a total acid hydrolysis to extract glucose from lignocellulosic biomass, a dilute acid pretreatment is often used to pretreat biomass in order to disrupt the crystallinity of the carbohydrate polymers that are present in the plant material, and then cocktails of hydrolytic enzymes (cellulases, hemicellulases, etc.) are added to hydrolyze the polymers to their component sugars. To determine whether high-starch biomass would allow more glucose to be recovered during such an enzymatic hydrolysis procedure, 20 mg of milled tissue from each of the mixed samples (NB control mix and Transgenic mix) was pretreated with 0.25M sulfuric acid (pH 1.0) at 95° C. for 4 or 16 hrs, or at 120° C. for 1 hr. After adjusting the pH of the pretreated samples, enzymatic hydrolysis was carried out with a commercially available enzyme cocktail, Accellerase® (Genencor, Palo Alto Calif.). Hydrolysis with a "full cocktail" (FCt) Accellerase mixture involves 200 µL, Accellerase® 1500 and 100 µL Accellerase® XY per gram biomass at 50° C., pH 5.0, for 72 hrs. Following hydrolysis, glucose yield was measured using HPLC (FIG. 21). Referring to this figure, it was observed, that under all three pretreatment and hydrolysis conditions, more free glucose was recovered from the transgenic, high-starch biomass than could be recovered from the control biomass.

Figure 22:
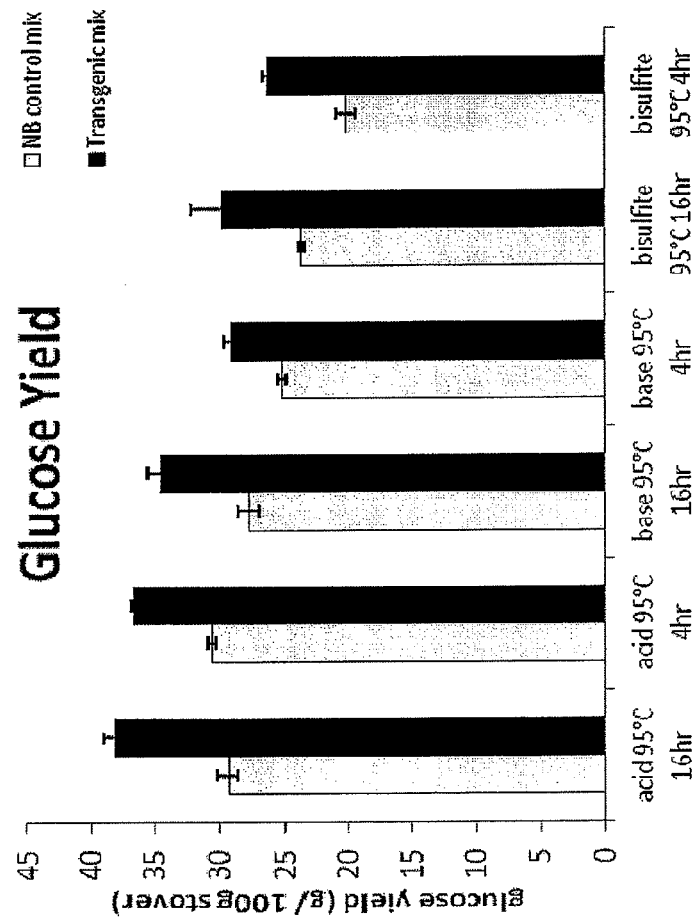
FIG. 22 illustrates glucose recovery from NB control mix (white bars) and transgenic mix (black bars) produced with constructs pAG2110, pAG2115 and pAG2116 following pretreatment with 0.25M sulfuric acid (acid; pH 1.0), 7.5% $NH_4OH$ (base; pH 12.0) or 0.175M $(NH_4)HSO_3$+0.18M $(NH_4)_2CO_3$ (bisulfite; pH 8.1) at 95° C. for 4 or 16 hours.
Figure 23:
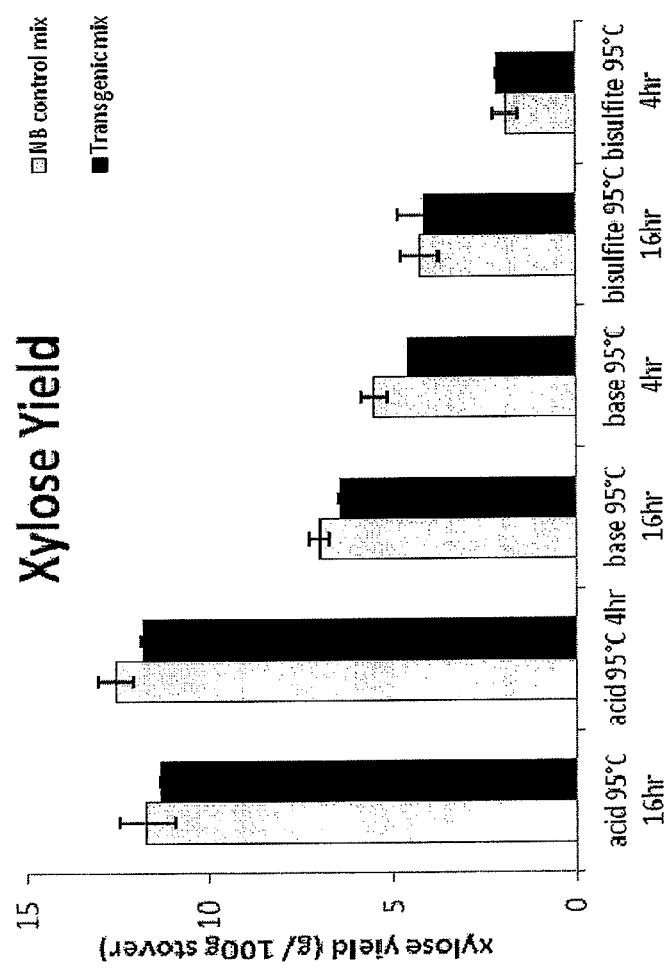
FIG. 23 illustrates xylose recovery from control (white bars) and transgenic biomass (black bars) following pretreatment with 0.25M sulfuric acid (acid; pH 1.0), 7.5% $NH_4OH$ (base; pH 12.0) or 0.175M $(NH_4)HSO_3$+0.18M $(NH_4)_2CO_3$ (bisulfite; pH8.1) at 95° C. for 4 or 16 hours.

To determine whether increased glucose could be recovered from the transgenic straw when alternative methods of biomass pretreatment were employed, samples of the NB control mix and the Transgenic mix biomass were subjected to three different pretreatment strategies. 20 mg milled tissue was pretreated with a dilute acid pretreatment (0.25M sulfuric acid at pH 1.0), a base pretreatment (7.5% $NH_4OH$ at pH 12.0), or a bisulfite pretreatment (0.175M $NH_4HSO_3$+0.18M $(NH_4)_2CO_3$; bisulfite at pH 8.1). Following pretreatment, samples were hydrolyzed with an enzyme cocktail as described above. The amounts of glucose and xylose that were released following each pretreatment and hydrolysis were quantified by HPLC (FIGS. 22 and 23). As can be seen in FIG. 22, for each pretreatment more glucose was recovered from the transgenic biomass than was recovered from the control biomass. In contrast, as can be seen in FIG. 23, under each pretreatment condition, xylose yields from the transgenic biomass were very similar to or slightly lower than the xylose yields from the control biomass, reflecting the fact that the transgenic biomass had a slightly lower xylose content on a per gram dry weight basis, as determined earlier from the total compositional analysis (See Table 5).

These observations indicate that increasing starch content of the biomass enables the recovery of more glucose per unit of biomass. Furthermore, comparison of the glucose yield from acid pretreated (95° C. 16 h) NB control mix sample with the glucose yield from the bisulfate pretreated (95° C. 16 h) transgenic mix sample as shown in FIG. 22 indicates that, although a mild pretreatment, such as the bisulfate pretreatment described above, might release glucose less efficiently than an acid or a base pretreatment, as much or more glucose can be recovered from the transgenic biomass with even a mild pretreatment than can be recovered from the control biomass following a harsh acid or base pretreatment. Using a mild pretreatment would enable processing facilities with less expensive capital equipment; conversely, using the transgenic material in a more severe pretreatment would increase glucose yields, improving the return on investment of that equipment.

Figure 24:
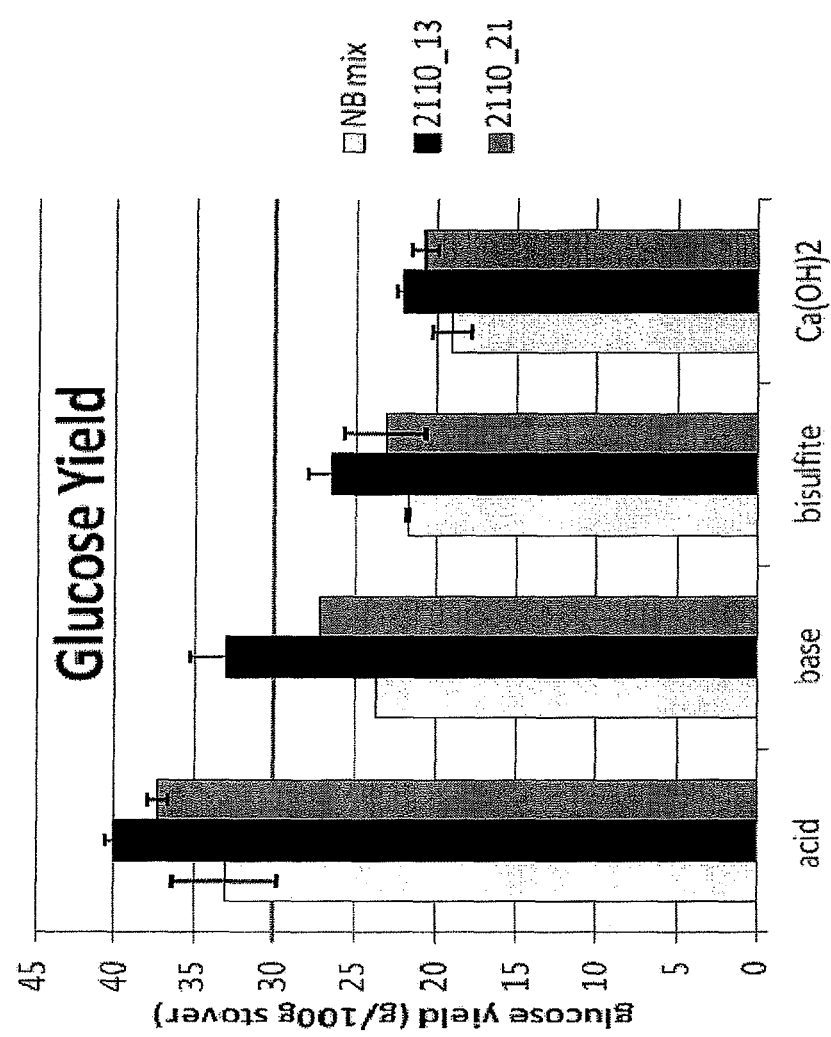
FIG. 24 illustrates glucose yields from biomass from individual transgenic rice plants 2110_13 (black bars) and 2110_21 (dark gray bars) produced from construct pAG2110 compared to that from control tissue (NB mix; white bars) following pretreatments with acid, base, bisulfite or $Ca(OH)_2$, and enzymatic hydrolysis.

In a similar experiment, samples from two individual transgenic rice plants 2110_13 and 2110_21 and the NB control mix were pretreated under four different conditions, then subjected to enzymatic hydrolysis (FIG. 24). Twenty milligrams of milled tissue was pretreated with an acid pretreatment (0.25M sulfuric acid at pH 1.0), a base pretreatment (7.5% $NH_4OH$ at pH 12.0), a bisulfite pretreatment (0.175M $NH_4HSO_3$+0.18M $(NH_4)_2CO_3$ at pH 8.1), or a calcium hydroxide pretreatment [saturated $Ca(OH)_2$] at 120° C. for 1 hr with a liquor-to-solids ratio of 10, followed by enzymatic digestion as described previously. Glucose yields were quantified via HPLC. Referring to FIG. 24, overall performance of the pretreatments differ markedly, but in each case more glucose was recovered from the transgenic rice biomass than was recovered from the control biomass. These results also show that the benefit from the increased starch accumulation in the transgenic plants can be seen in biomass derived from a single plant line, and need not involve a blend of biomass from multiple independent plant lines.

Example 13

Simultaneous Saccharification and Fermentation of Biomass

Ethanol, organic acids, or other biochemicals can be produced from lignocellulosic biomass through simultaneous saccharification and fermentation (SSF). This process utilizes biomass pretreatment, as described above, followed by the hydrolysis of the biomass with enzyme cocktails in the presence of yeasts or other microorganisms, which will metabolize the resulting sugars to produce ethanol, organic acids, and/or additional biochemicals.

To determine whether biomass from the high-starch transgenic rice would support the production of more ethanol relative to control biomass via SSF, 3 g of biomass from either the NB control mix or the transgenic mix was pretreated with 0.25 M $H_2SO_4$ pH 1.0 at 120° C. for 1 hr in a pressure cooker. Hydrolysis was carried out at pH 4.9 at 50° C. with the full Accellerase cocktail (FCt). FCt contains 200 μL Accellerase® 1500 per 1 g biomass and 100 μL Accellerase® XY per 1 g biomass. YP medium (10 g/L yeast extract, 20 g/L peptone) was added to the hydrolysate to aid in yeast growth, and then an inoculum of D5A yeast cells was added from a frozen stock. A "glucose control" sample was also prepared that employed pure glucose (approximately 20-22 g/L) in the medium in place of the hydrolyzed biomass.

Figure 25:
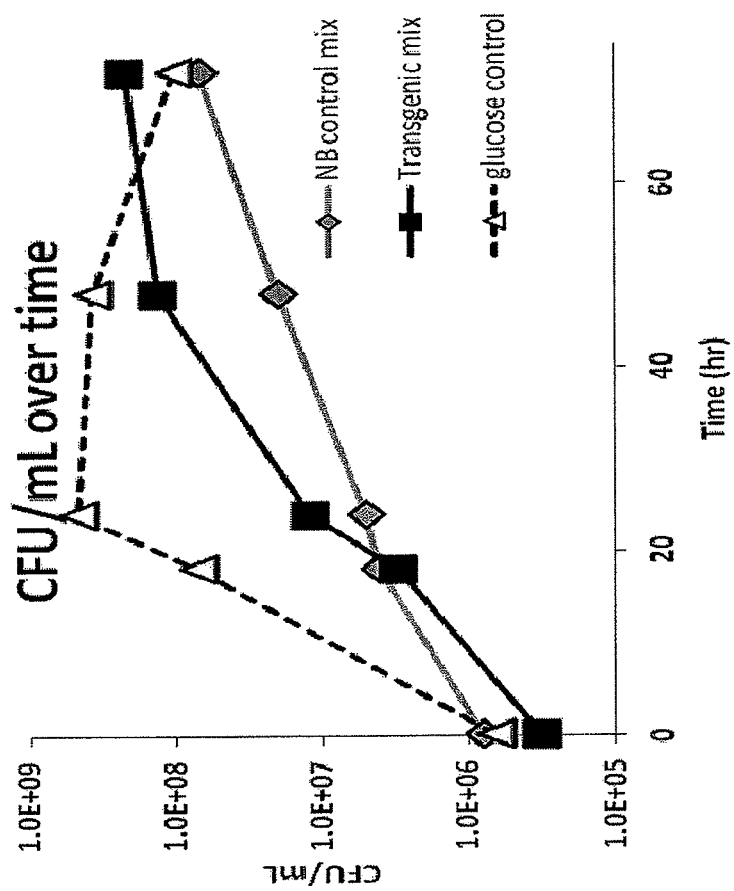
FIG. 25 illustrates growth of yeast cells as measured by numbers of colony forming units per mL of culture volume (CFU/mL) during simultaneous saccharification and fermentation of rice biomass (square; transgenic mix), non-transgenic control plants (diamond; NB control mix) and glucose control (triangle).

FIG. 25 illustrates changes in yeast culture titers (CFU/mL) during simultaneous saccharification and fermentation of transgenic biomass (square; transgenic mix), non-transgenic control plants (diamond: NB control mix) and glucose control (triangle). As can be seen in FIG. 25, all three samples supported the growth of the fermenting organism, yeast in this example. Pure glucose supported the most rapid growth of the yeast, and yeast growth reached a plateau sooner when grown on pure glucose than when grown on the biomass hydrolysates. By 24 hours, transgenic biomass supported the growth of more yeast than did the control biomass.

Figure 26:
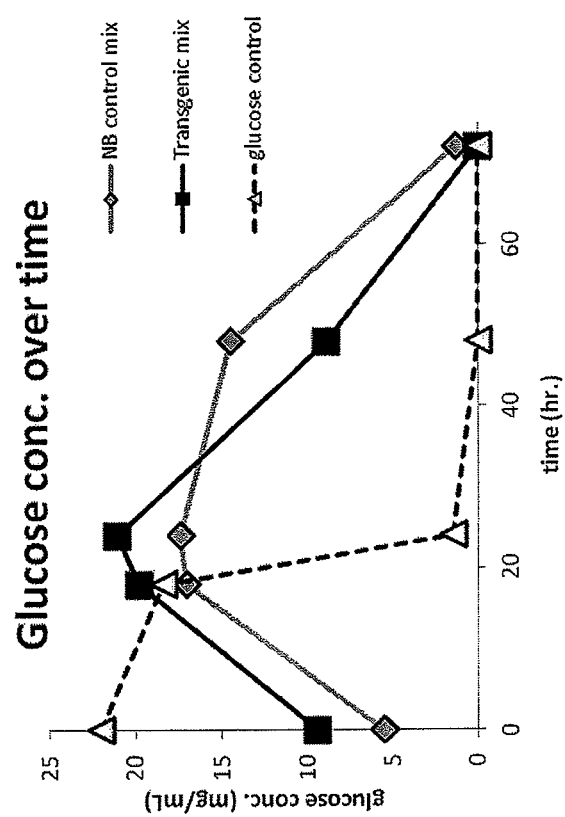
FIG. 26 illustrates release and consumption of glucose during simultaneous sacharification and fermentation of rice biomass (square; transgenic mix), non-transgenic control plants (diamond; NB control mix) and glucose control (triangle).

FIG. 26 illustrates release and consumption of glucose during SSF and fermentation of transgenic biomass, non-transgenic control plant and the glucose control. Referring to FIG. 26, it was observed that saccharification; i.e., hydrolysis of the polysaccharides in the biomass to their component sugars, is occurring at the same time as yeast cells are growing during SSF and glucose concentrations in biomass hydrolysates increases initially, while glucose concentrations in the "glucose control" medium decrease immediately. As the yeast populations increase and biomass is depleted, the glucose concentrations begin to drop in media that contain biomass as well.

Figure 27:
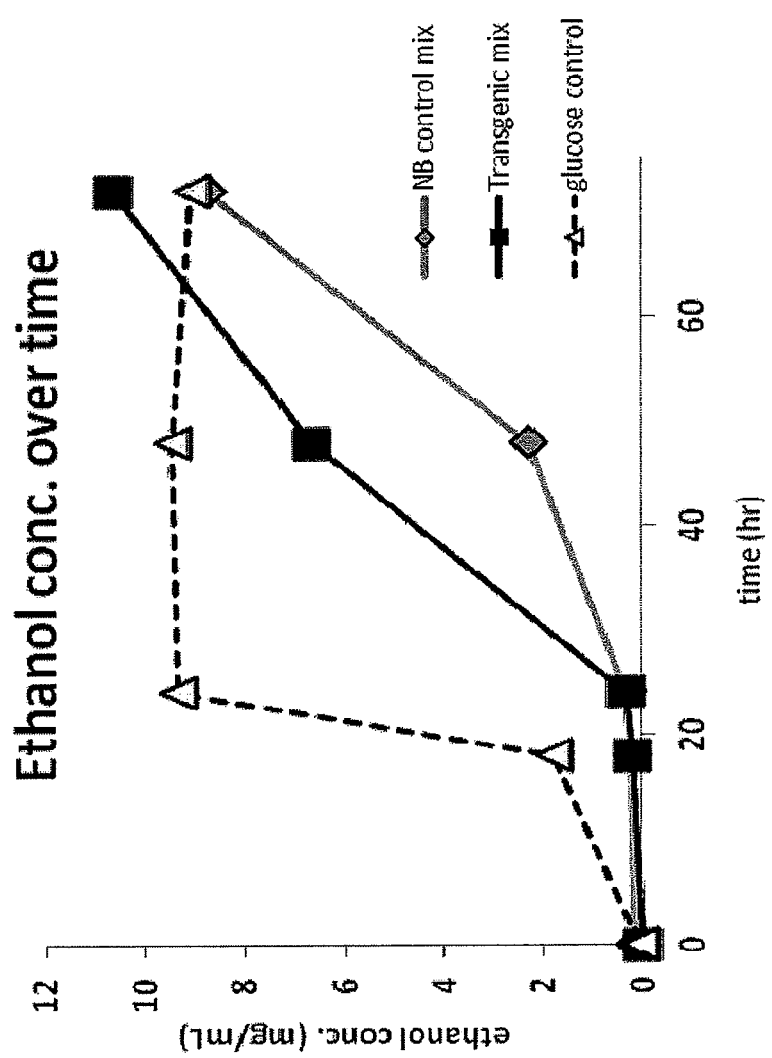
FIG. 27 illustrates ethanol production during simultaneous sacharification and fermentation of rice biomass (square; transgenic mix), non-transgenic control plants (diamond; NB control mix) and glucose control (triangle).

FIG. 27 illustrates ethanol production during simultaneous sacharification and fermentation of rice biomass, non-transgenic control plants and glucose control. Consistent with the rapid consumption of glucose seen in cultures containing the "glucose control," the control cultures also produce ethanol sooner than do the cultures grown on biomass hydrolysates. By 48 hours, though, both types of biomass hydrolysates support the production of significant amounts of ethanol. Consistent with a higher content of easily-hydrolyzed starch, the transgenic mix biomass supports a more rapid production of ethanol as well as a higher final concentration of ethanol (final concentration: 17.1 g ethanol/100 g biomass) than does the NB control mix biomass (final concentration: 14.2 g ethanol/100 g stover).

Based upon the initial amounts of glucose that were present in each culture as glucan polymers in the biomass samples, it is possible to calculate the effective ethanol yield on glucose, using Equation 1:

$$\% \ CelluloseConversion = \frac{[EtOH]_f - [EtOH]_0}{0.51 * f[Biomass]} \times 100\%$$

where the $[EtOH]_f$ is the final ethanol concentration (g/L), $[EtOH]_0$ is the initial ethanol concentration (g/L), 0.51 is the conversion factor for glucose to ethanol based on the stoichiometric biochemistry of yeast, f is the glucan (glucose polysaccharide) fraction of the dry biomass, and [Biomass] is the starting concentration (g/L) of the dry biomass in the sample. Using this equation, there was a higher ethanol conversion rate from the transgenic biomass than from the control biomass, as shown in Table 6.

TABLE 6

Ethanol conversion rates of control and transgenic biomass.

| | % EtOH Conversion | | % EtOH yield |
|---|---|---|---|
| Strain | NB control mix | Transgenic mix | Glucose Control |
| % Conversion | 81.83 | 84.12 | 89.45 |

It was observed that the ethanol conversion rate on the transgenic biomass was closer that observed on pure glucose, indicating that ethanol fermentation can proceed more efficiently from transgenic, high-starch biomass than from control biomass.

Example 14

Combining Starch Accumulation with the Expression of Polysaccharide Degrading Enzymes While increased starch accumulation in the transgenic biomass enables the release of more glucose from biomass during hydrolysis or SSF, it may be possible to convert even more of the available glucan into glucose by producing polysaccharide degrading enzymes in the biomass while plants are growing at the same time that starch is accumulating. Plant cell walls are composed of numerous polysaccharides, including glucan polymers such as cellulose, β-glucan, and xyloglucans, as well as other complex polysaccharides such as hemicelluloses (heteroxylans), pectins, etc. Expressing enzymes that degrade these polysaccharides will make it possible to decompose these polysaccharides into their component sugars more readily, thereby providing an additional benefit to high-starch biomass for animal feed or fermentation applications, in which fermentable or digestible sugars are more efficiently recovered from both vegetative starch and structural polysaccharides.

A number of polysaccharide degrading enzymes can be employed for this objective. Examples of these polysaccharide degrading enzymes are provided as SEQ ID NO: 77 (O43097 xylanase), SEQ ID NO: 78 (BD22308 cellobiohydrolase), SEQ ID NO: 79 (BD25243 endoglucanase), SEQ ID NO: 80 (EU591743 xylanase), SEQ ID NO: 81 (NtEGm endoglucanase), SEQ ID NO: 82 (P0C2S1 cellobiohydrolase), SEQ ID NO: 83 (P77853 xylanase), SEQ ID NO: 84 (O68438 cellobiohydrolase), SEQ ID NO: 85 (O33897 endoglucanase), SEQ ID NO: 160 (amylase 19862), SEQ ID NO: 161 (glucoamylase 20082), SEQ ID NO: 162 (glucoamylase 20707), SEQ ID NO: 163 (amylase 21853), SEQ ID NO: 169 (AmyS), and SEQ ID NO: 171 (GlaA). These enzymes can be encoded by DNA sequences SEQ ID NO: 86 (O43097 xylanase), SEQ ID NO: 87 (BD22308 cellobiohydrolase), SEQ ID NO: 88 (BD25243 endoglucanase), SEQ ID NO: 89 (EU591743 xylanase), SEQ ID NO: 90 (NtEGm endoglucanase), SEQ ID NO: 91 (P0C2S1 cellobiohydrolase), SEQ ID NO: 92 (P77853 xylanase), SEQ ID NO: 93 (O68438 cellobiohydrolase), SEQ ID NO: 94 (O33897 endoglucanase), SEQ ID NO: 164 (amylase 19862), SEQ ID NO: 165 (glucoamylase 20082), SEQ ID NO: 166 (glucoamylase 20707), SEQ ID NO: 167 (amylase 21853), SEQ ID NO: 168 (AmyS), and SEQ ID NO: 170 (GlaA).

Because the activity of polysaccharide degrading enzymes in living plant tissues may interfere with plant growth or development, it may be helpful to express such enzymes as inactive precursors, for example, as intein-modified pro-enzymes that can be activated after the biomass has been harvested by regulating the conditions under which inteins can be activated (See the following references for intein-modified pro-enzymes that may be utilized herein. PCT patent application PCT/US03/00432 filed Jan. 7, 2003, PCT/US2010/055669 filed Nov. 5, 2010, PCT/US2010/055751 filed Nov. 5, 2010, PCT/US2010/055746 filed Nov. 5, 2010, U.S. Pat. No. 8,247,647 issued Aug. 21, 2012, and U.S. patent application Ser. No. 12/590,444 filed Nov. 6, 2009, all of which are incorporated by reference herein as if fully set forth). Examples of inteins that can be employed for this purpose are provided as the polypeptides SEQ ID NO: 95 (AS146-7 intein polypeptide), SEQ ID NO: 96 (S158-30-108-35), and SEQ ID NO: 97 (T134-100-101), which can be encoded by the DNA sequences SEQ ID NO: 98 (AS146-7), SEQ ID NO: 99 (S158-30-108-35), and SEQ ID NO: 100 (T134-100-101). Examples of enzymes that incorporate such inteins are provided as SEQ ID NO: 101 (EU591743:AS146-7), SEQ ID NO: 102 (P77853:S158-30-108-35), and SEQ ID NO: 103 (P77853:T134-100-101), which can be encoded by the DNA sequences provided as SEQ ID NO: 104 (EU591743:AS146-7), SEQ ID NO: 105 (P77853:S158-30-108-35), and SEQ ID NO; 106 (P77853:T134-100-101).

Expression cassettes can be constructed such that transcription of the CWDE is directed by a suitable promoter. Examples of such promoters are provided as SEQ ID NO: 55 (ZmUbi1P), SEQ ID NO: 56 (ZmPepCP) and SEQ ID NO: 57 (OsUbi3P). Transcription from this cassette can be terminated by employing a suitable polyadenylation signal. An example of such a signal is provided as SEQ ID NO: 58 (NOS terminator). Furthermore, accumulation, stability, and/or subcellular targeting of a given polysaccharide degrading enzyme can be modified by expressing them as fusions with suitably chosen N-terminal or C-terminal polypeptides. Examples of such polypeptides are provided as SEQ ID NO: 107 (BAASS signal peptide), SEQ ID NO: 108 (SEKDEL signal peptide), SEQ ID NO: 109 (xHvVSD targeting signal), SEQ ID NO: 110 (ZmUBQm translational fusion), SEQ ID NO: 111 (xGZein27ss), and SEQ ID NO: 112 (HvAle signal), which can be encoded by DNA sequences provided as SEQ ID NO: 113 (BAASS), SEQ ID NO: 114 (SEKDEL), SEQ ID NO: 115 (xHvVSD), SEQ ID NO: 116 (ZmUBQm), SEQ ID NO: 117 (xGZein27ss), and SEQ ID NO: 118 (HvAle).

Figure 28:
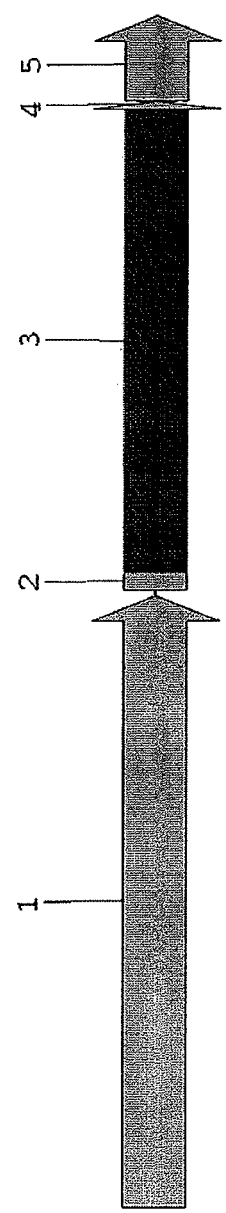
FIG. 28 illustrates a diagram of an expression cassette for a single cell wall degrading enzyme (CWDE).

FIG. 28 illustrates the organization of a CWDE expression cassette which includes (1) a promoter element, (2) N-terminal signal peptide, (3) a coding sequence for CWDE (black), (4) C-terminal peptide, and (5) a transcriptional terminator/polyadenylation signal. In this example the CWDE (black) is expressed as a translational fusion with an N-terminal signal peptide as well as a C-terminal peptide.

Examples of other CWDE expression cassettes are provided as SEQ ID NO: 119 (ZmUbi1P:xGZein27ss:BD22308:xHvVSD, SEQ ID NO: 120 (ZmPepCP:xGZein27ss:BD25243:SEKDEL), SEQ ID NO: 121 (OsUbi3P:EU591743), SEQ ID NO: 122 (ZmUbi1P:EU591743:AS146-7:SEKDEL), SEQ ID NO: 123 (ZmUbi1P:HvAle:NtEGm:SEKDEL), SEQ ID NO: 124 (ZmPepCP:HvAle:NtEGm:SEKDEL), SEQ ID NO: 125 (OsUbi3P:HvAle:NtEGm:SEKDEL), SEQ ID NO: 126 (OsUbi3P:BAASS:O33897), SEQ ID NO: 127 (ZmPepCP:BAASS:O43097:SEKDEL), SEQ ID NO: 128 (OsUbi3P:O68438), SEQ ID NO: 129 (OsUbi3P:P0C2S1), SEQ ID NO: 130 (ZmUbi1P:ZmUBQm:BAASS:P77853:S158-30-108-35 and SEQ ID NO: 131 (ZmUbi1P:BAASS:P77853:T134-100-101:SEKDEL).

Multiple CWDEs and hpRNAs can be expressed simultaneously in transgenic plants by constructing a transformation vector that has multiple expression cassettes linked in tandem.

Figure 29:
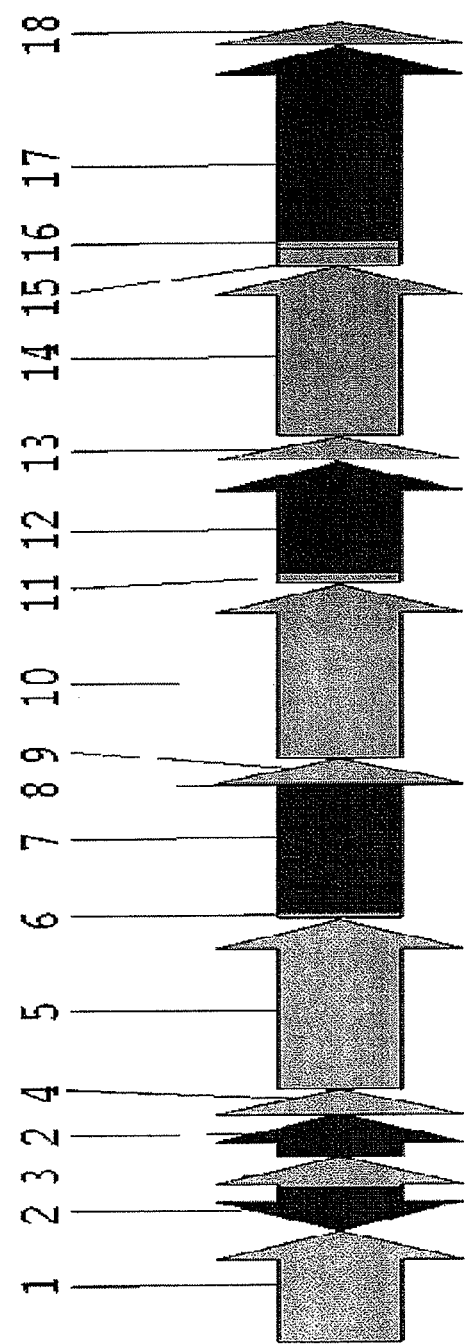
FIG. 29 illustrates one construct comprised of one expression cassette for an hpRNA and expression cassettes for three CWDEs.

FIG. 29 illustrates one such construct. The construct includes (1) a first promoter element, (2) a set of driver sequences positioned in opposite orientations such that the RNA transcript will be self-complementary in these regions, (3) an intron or a spacer element, (4) a first transcriptional terminator/polyadenylation signal, (5) a second promoter element, (6) a first N-terminal signal peptide, (7) a coding sequence for a first CWDE, (8) a first C-terminal signal peptide, (9) a second transcriptional terminator/polyadenylation signal, (10) a third promoter element, (11) a second N-terminal signal peptide, (12) a coding sequence for a second CWDE, (13) a third transcriptional terminator/polyadenylation signal, (14) a fourth promoter element, (15) a N-terminal fusion protein/leader sequence, (16) a third N-terminal signal peptide, (17) a coding sequence for a third CWDE, and (18) a fourth transcriptional terminator, polyadenylation signal.

Following are descriptions of vectors that can be used to introduce the above-described constructs into plant cells via Agrobacterium-mediated transformation.

pAG4003 (SEQ ID NO: 76) is a plasmid that carries a spectinomycin resistance marker, a bacterial origin of replication, an Agrobacterium T-DNA right border (RB), and an Agrobacterium T-DNA left border (LB). Between the RB and LB is a plant selectable marker comprised of a maize ubiquitin promoter (ZmUbi1P), the phosphomannose isomerase coding sequence, and NOS terminator pAG4106 is a derivative of pAG4003 (SEQ ID NO: 76) carrying a quadruple stack construct (SEQ ID NO: 134) with ZmPepCP:ZmGWD1 RNAi+ZmUbi1P:xGZein27ss:BD22308:xHvVSD+OsUbi3P:HvAle:NtEGm:SEKDEL+ZmUbi1P:ZmUBQm:BAASS:P77853:S 158-30-108-35 pAG4107 is a derivative of pAG4003 (SEQ ID NO: 76) carrying a quadruple stack construct (SEQ ID NO: 135) with ZmPepCP:ZmGWD2 RNAi+ZmUbi1P:xGZein27ss:BD22308:xHvVSD+OsUbi3P:HvAle:NtEGm:SEKDEL+ZmUbi1P:ZmUBQm:BAASS:P77853:S158-30-108-35 pAG4108 is a derivative of pAG4003 (SEQ ID NO: 76) carrying a quadruple stack construct (SEQ ID NO: 136) with ZmPepCP:SbGWD1 RNAi+ZmUbi1P:xGZein27ss:BD22308:xHvVSD+OsUbi3P:HvAle:NtEGm:SEKDEL+ZmUbi1:ZmUBQm:BAASS:P77853:S158-30-108-35 pAG4109 is a derivative of pAG4003 (SEQ ID NO: 76) carrying a quadruple stack construct (SEQ ID NO: 137) with ZmPepCP:SbGWD2 RNAi+ZmUbi1P:xGZein27ss:BD22308:xHvVSD+OsUbi3P:HvAle:NtEGm:SEKDEL+ZmUbi1P:ZmUBQm:BAASS:P77853:S 158-30-108-35 pAG4110 is a derivative of pAG4003 (SEQ ID NO: 76) carrying a quadruple stack construct (SEQ ID NO: 138) with ZmPepCP:ZmGWD1 RNAi+ZmUbi1P:xGZein27:BD22308:xHvVSD+OsUbi3P:HvAle:NtEGm:SEKDEL:NOST+ZmPEPCP:BAASS:O43097:SEKDEL pAG4111 is a derivative of pAG4003 (SEQ ID NO: 76) carrying a quadruple stack construct (SEQ ID NO: 139) with ZmPepCP:ZmGWD2 RNAi+ZmUbi1P:xGZein27: BD22308:xHvVSD+OsUbi3P:HvAle:NtEGm:SEKDEL: NOST+ZmPepCP:BAASS:O43097:SEKDEL pAG4112 is a derivative of pAG4003 (SEQ ID NO: 76) carrying a quadruple stack construct (SEQ ID NO: 140) with ZmPepCP:ZmGWD1 RNAi+ZmUbi1P:xGZein27: BD22308:xHvVSD+ZmUbi1P:HvAle:NtEGm:SEKDEL+ ZmUbi1P:BAASS:EU591743:AS146-7:SEKDEL pAG4113 is a derivative of pAG4003 (SEQ ID NO: 76) carrying a quadruple stack construct (SEQ ID NO: 141) with ZmPepCP:ZmGWD2 RNAi+ZmUbi1P:xGZein27: BD22308:xHvVSD+ZmUbi1P:HvAle:NtEGm:SEKDEL+ ZmUbi1P:BAASS:EU591743:AS146-7:SEKDEL pAG4114 is a derivative of pAG4003 (SEQ ID NO: 76) carrying a quadruple stack construct (SEQ ID NO: 142) with ZmPepCP:ZmGWD1 RNAi+ZmUbi1P:xGZein27: BD22308:xHvVSD+ZmPepCP:xGZein27ss:BD25243: SEKDEL+ZmUbi1P:BAASS:EU591743:AS146-7: SEKDEL pAG4115 is a derivative of pAG4003 (SEQ ID NO: 76) carrying a quadruple stack construct (SEQ ID NO: 143) with ZmPepCP:ZmGWD2 RNAi+ZmUbi1P:xGZein27: BD22308:xHvVSD+ZmPepCP:xGZein27ss:BD25243: SEKDEL+ZmUbi1P:BAASS:EU591743:AS146-7: SEKDEL pAG4116 is a derivative of pAG4003 (SEQ ID NO: 76) carrying a quadruple stack construct (SEQ ID NO: 144) with ZmPepCP:ZmGWD1 RNAi+ZmUbi1P:xGZein27: BD22308:xHvVSD+OsUbi3P:HvAle:NtEGm:SEKDEL+ ZmUbi1P:BAASS:EU591743:AS146-7:SEKDEL pAG4117 is a derivative of pAG4003 (SEQ ID NO: 76) carrying a quadruple stack construct (SEQ ID NO: 145) with ZmPepCP:ZmGWD2 RNAi+ZmUbi1P:xGZein27: BD22308:xHvVSD+OsUbi3P:HvAle:NtEGm:SEKDEL+ ZmUbi1P:BAASS:EU591743:AS146-7:SEKDEL pAG4120 is a derivative of pAG4003 (SEQ ID NO: 76) carrying a quadruple stack construct (SEQ ID NO: 146) with ZmPepCP:ZmGWD1 RNAi+OsUbi3P:P0C2S1+OsUbi3P: HvAleSp:NtEGm:SEKDEL+ZmUbi1P:ZmUBQm: BAASS:P77853-T134-100-101:SEKDEL pAG4121 is a derivative of pAG4003 (SEQ ID NO: 76) carrying a quadruple stack construct (SEQ ID NO: 147) with ZmPEPCP:ZmGWD2 RNAi+OsUbi3P:P0C2S1+OsUbi3P: HvAleSp:NtEGm:SEKDEL+ZmUbi1P:ZmUBQm: BAASS:P77853-T134-100-101:SEKDEL pAG4124 is a derivative of pAG4003 (SEQ ID NO: 76) carrying a triple stack construct (SEQ ID NO: 148) with ZmPepCP:ZmGWD1 RNAi+ZmPepCP:xGZein27ss: BD25243:SEKDEL+ZmUbi1P:BAASS:EU591743:AS146-7:SEKDEL pAG4125 is a derivative of pAG4003 (SEQ ID NO: 76) carrying a triple stack construct (SEQ ID NO: 149) with ZmPepCP:ZmGWD2 RNAi+ZmPepCP:xGZein27ss: BD25243:SEKDEL+ZmUbi1P:BAASS:EU591743:AS146-7:SEKDEL pAG4206 is a derivative of pAG4003 carrying a triple stack construct (SEQ ID NO: 219) with ZmUbi1P:xG-Zein27:BD22308:xHvVSD+OsUbi3P:HvAle:NtEGm: SEKDEL:NosT+ZmPepCP:BAASS:O43097:SEKDEL pAG4514 is a derivative of pAG4003 (SEQ ID NO: 76) carrying a quadruple stack construct (SEQ ID NO: 150) with ZmPepCP:ZmGWD1 RNAi+ZmUbi1P:xGZein27: BD22308:xHvVSD+ZmPepCP:HvAle:NtEGm:SEKDEL+ ZmUbi1P:BAASS:EU591743:AS146-7:SEKDEL pAG4515 is a derivative of pAG4003 (SEQ ID NO: 76) carrying a quadruple stack construct (SEQ ID NO: 151) with ZmPepCP:ZmGWD2 RNAi+ZmUbi1P:xGZein27: BD22308:xHvVSD+ZmPepCP:HvAle:NtEGm:SEKDEL+ ZmUbi1P:BAASS:EU591743:AS146-7:SEKDEL Example 15

Figure 30:
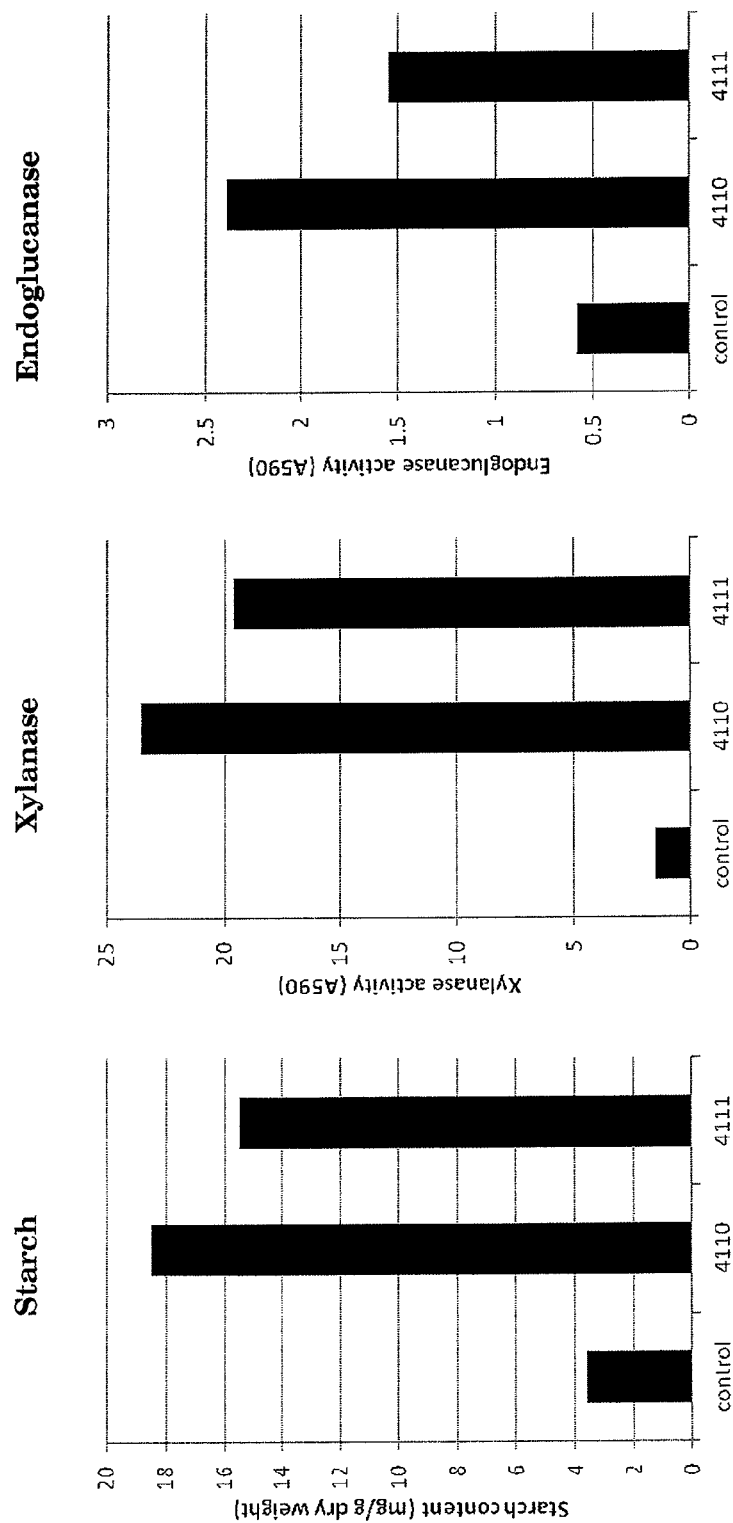
FIG. 30 illustrates starch content, xylanase activity and endoglucanase activity among transgenic plants carrying pAG4110 and pAG4111 expression cassettes and control plants.
Figure 31:
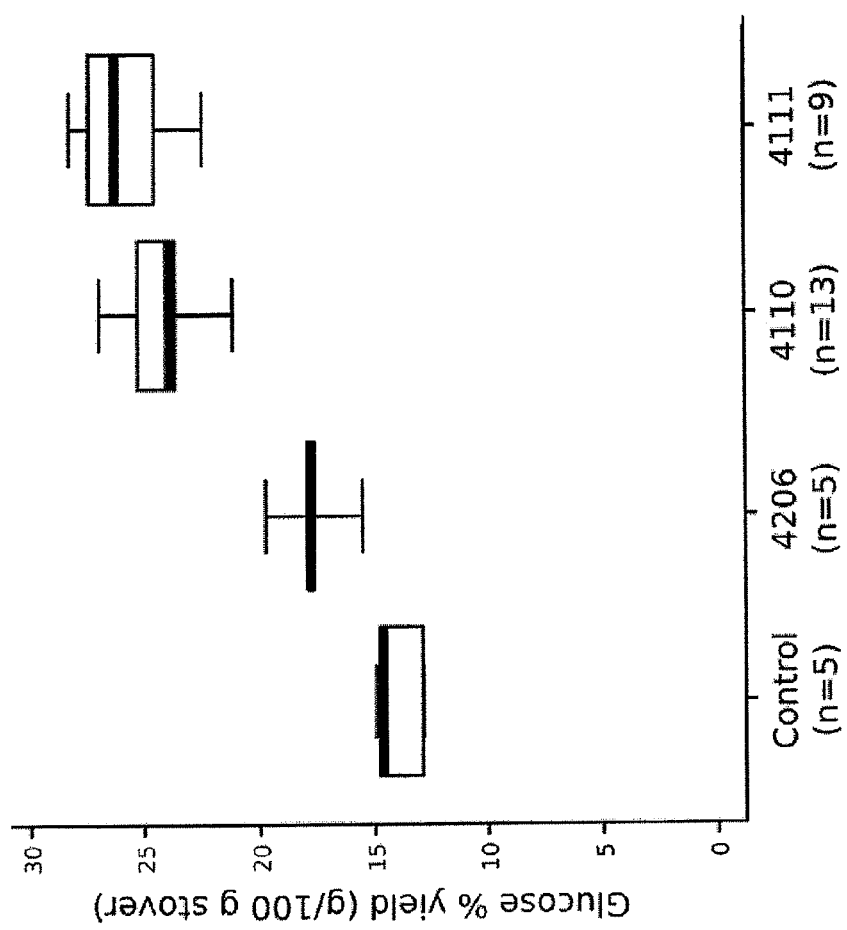
FIG. 31 illustrates glucose yields from transgenic plants carrying pAG4206, pAG4110 and pAG4111 expression cassettes and WT controls.

More Glucose can be Recovered from Transgenic Plants that Accumulate Starch and Express Cell Wall Degrading Enzymes Individual control and transgenic maize plants carrying either construct 4110 or 4111 were grown to maturity in a greenhouse. Leaves and stalks were harvested from the mature, senescent plants, dried, and milled. Samples from each were assayed for starch content, xylanase activity, and endoglucanase activity using (respectively) the Total Starch Assay Kit, Xylazyme, and Cellazyme chromogenic substrates from Megazyme (Bray, County Wicklow, Ireland). As shown in FIG. 30, biomass from plants carrying construct 4110 and 4111 accumulate more starch than the control plant, while also expressing xylanase and endoglucanase enzymes. When biomass from these plants was pretreated and hydrolyzed as described above it was possible to recover more glucose from the transgenic plants. Furthermore, plants that accumulated starch and cell wall degrading enzymes yielded more glucose than did plants that only expressed the cell wall degrading enzymes, as shown in FIG. 31.

It is understood, therefore, that this invention is not limited to the particular embodiments disclosed, but is intended to cover all modifications which are within the spirit and scope of the invention as defined by the appended claims; the above description; and/or shown in the attached drawings.

REFERENCES

Alvira, P et al., 2010. Pretreatment technologies for an efficient bioethanol production process based on enzymatic hydrolysis: A review. *Bioresource technology*, 101 (13), pp. 4851-61. Available at: http://www.ncbi.nlm.nih.gov/pubmed/20042329 [Accessed Jul. 18, 2012].

An, G et al., 2005. Reverse genetic approaches for functional genomics of rice. *Plant molecular biology*, 59(1), pp. 111-23. Available at: http://www.ncbi.nlm.nih.gov/pubmed/16217606 [Accessed Jul. 25, 2012].

Ausubel F M, Brent R, Kingston R E, Moore D D, Seidman J G, Smith J A, Struhl K, 2000. Current Protocols in Molecular Biology Volume 1, John Wiley & Sons.

Charles Abbas, Wuli Bao, Kyle Beery, Mike Cecava, Perry H. Doane, James L. Dunn, D. P. H., 2008. Abbas 2008 US Patent Application US20080220125.pdf., pp. 1-17.

Chi-Ham C L et al., 2010. The intellectual property landscape for gene suppression technologies in plants. *Nature Biotechnology*, 28 (1):32-36.

Christian, M et al., 2010. Targeting DNA double-strand breaks with TAL effector nucleases. Genetics, 186(2), pp. 757-61. Available at: http://www.pubmedcentral.nih.gov/articlerender.fcgi?artid=2942870&tool=pmcentrez&-rendertype=abstract [Accessed Jul. 14, 2012].

Frizzi A & Huang S, 2010. Tapping RNA silencing pathways for plant biotechnology. *Plant biotechnology journal*, 8(6), pp. 655-77. Available at: http://www.ncbi.nlm.nih.gov/pubmed/20331529 [Accessed Jul. 24, 2012].

Horiguchi G, 2004. RNA silencing in plants: a shortcut to functional analysis. *Differentiation; research in biological diversity*, 72(2-3), pp. 65-73. Available at: http://www.ncbi.nlm.nih.gov/pubmed/15066186.

Horton R M, Hunt H D, Ho S N, Pullen J and Pease L R, 1989. Engineering hybrid genes without the use of restriction enzymes: gene splicing by overlap extension. *Gene* 77(1):61-68.

Kavakli I H et al., 2002. Generation, characterization, and heterologous expression of wild-type and up-regulated forms of *Arabidopsis thaliana* leaf ADP-glucose pyrophosphorylase. *Planta,* 215(3), pp. 430-9. Available at: http://www.ncbi.nlm.nih.gov/pubmed/12111225 [Accessed Jul. 25, 2012].

Köttin, O et al., 2009. STARCH-EXCESS4 is a laforin-like Phosphoglucan phosphatase required for starch degradation in *Arabidopsis thaliana. The Plant cell,* 21(1), pp. 334-46. Available at: http://www.pubmedcentral.nih.gov/articlerender.fcgi?artid=2648081&tool=pmcentrez&=-rendertype=abstract [Accessed Jul. 25, 2012].

Krishnan A, Guiderdoni E, An G, Hsing Y I, Han C D, Lee M C, Yu S M, Upadhyaya N, Ramachandran S, Zhang Q, Sundaresan V, Hirochika H, Leung H and Pereira A, 2009. Mutant resources in rice for functional genomics of the grasses. Plant Physiol. 149:165-70.

Maniatis T, Fritsch E F and J. Sambrook J, 1982. Molecular Cloning Cold Spring Harbor Laboratory.

Obana Y et al., 2006. Enhanced turnover of transitory starch by expression of up-regulated ADP-glucose pyrophosphorylases in *Arabidopsis thaliana. Plant Science,* 170 (1), pp. 1-11. Available at: http://linkinghub.elsevier.com/retrieve/pii/S0168945205002670 [Accessed Jul. 25, 2012].

Puchta H, Dujon B and Hohn B, 1993. Homologous recombination in plant cells is enhanced by in vivo induction of double strand breaks into DNA by a site-specific endonuclease. *Nucleic acids research,* 21(22), pp. 5034-40. Available at: http://www.pubmedcentral.nih.gov/articlerender.fcgi?artid=310614&tool=pmcentrez&-rendertype=abstract.

Sikora P et al., 2011. Mutagenesis as a tool in plant genetics, functional genomics, and breeding. *International journal of plant genomics,* 2011, p. 314829. Available at: http://www.pubmedcentral.nih.gov/articlerender.fcgi?artid=3270407&tool=pmcentrez&-rendertype=abstract [Accessed Jul. 25, 2012].

Smith A M and Zeeman S C, 2006. Quantification of starch in plant tissues. Nat. Protocols 1:1342-1345

Smith N A, Singh S P, Wang M B, Stoutjesdijk P A, Green A G and Waterhouse P M, 2000. Total silencing by intron-spliced hairpin RNA, Nature 407:319-20.

Smith T F, Waterman M S, 1981. Identification of Common Molecular Subsequences. J Mol Biol 147: 195-197.

Stitt M & Zeeman, Samuel C, 2012. Starch turnover: pathways, regulation and role in growth. *Current opinion in plant biology,* 15(3), pp. 282-92. Available at: http://www.ncbi.nlm.nih.gov/pubmed/22541711 [Accessed Jul. 16, 2012].

Stoutjesdijk P A, Singh S P, Liu Q, Hurlstone C J, Waterhouse P A and Green A G, 2002. hpRNA-mediated targeting of the *Arabidopsis* FAD2 gene gives highly efficient and stable silencing. Plant Physiol. 129(4): 1723-31.

Till B J, Cooper J, Tai T H, Colowit P, Greene E A, Henikoff S, Comai L, 2007 Discovery of chemically induced mutations in rice by TILLING. BMC Plant Biol. 7:19.

Vainstein A et al., 2011. Permanent genome modifications in plant cells by transient viral vectors. *Trends in biotechnology,* 29(8), pp. 363-9. Available at: http://www.ncbi.nlm.nih.gov/pubmed/21536337 [Accessed Jul. 30, 2012].

Warthmann N et al., 2008. Highly specific gene silencing by artificial miRNAs in rice. *PloS one,* 3(3), p.e1829. Available at: http://www.pubmedcentral.nih.gov/articlerender.fcgi?artid=2262943&tool=pmcentrez&-rendertype=abstract [Accessed Jul. 25, 2012].

Wehrkamp-Richter S et al., 2009. Characterisation of a new reporter system allowing high throughput in planta screening for recombination events before and after controlled DNA double strand break induction. *Plant physiology and biochemistry*❓ *: PPB/Société française de physiologie végétale,* 47(4), pp. 248-55. Available at: http://www.ncbi.nlm.nih.gov/pubmed/19136269 [Accessed Jul. 17, 2012].

Wright D et al., 2005. High-frequency homologous recombination in plants mediated by zinc-finger nucleases. *The Plant journal*❓ *: for cell and molecular biology,* 44(4), pp. 693-705. Available at: http://www.ncbi.nlm.nih.gov/pubmed/16262717 [Accessed Jul. 19, 2012].

Yu T S et al., 2001. The *Arabidopsis* sex1 mutant is defective in the R1 protein, a general regulator of starch degradation in plants, and not in the chloroplast hexose transporter. *The Plant cell,* 13(8), pp. 1907-18. Available at: =abstract.

Zhang Z, Schwartz S, Wagner L, and Miller W, 2000. A greedy algorithm for aligning DNA sequences. J Comput Biol 2000; 7(1-2):203-14

The references cited throughout this application, are incorporated for all purposes apparent herein and in the references themselves as if each reference was fully set forth. For the sake of presentation, specific ones of these references are cited at particular locations herein. A citation of a reference at a particular location indicates a manner(s) in which the teachings of the reference are incorporated. However, a citation of a reference at a particular location does not limit the manner in which all of the teachings of the cited reference are incorporated for all purposes.

It is understood, therefore, that this invention is not limited to the particular embodiments disclosed, but is intended to cover all modifications which are within the spirit and scope of the invention as defined by the appended claims; the above description; and/or shown in the attached drawings.

SEQUENCE LISTING (219 sequences)

SEQ ID NO: 1 - protein, 1471 aa, Sorghum bicolor
  MISC_FEATURE (1)..(1469): SbGWD protein
ANMTGFSAAASAAAAAERCALAIRARPAASSPAKRQQQSASLRRSGGQRRPTTLAASRRSPVVVPRAIATSADRASHDLVGKFTLDSNSELLVAVNPAPQGLVSVIGLEVTNTSGSLILHWGVLRPDKRDWILPSRQPDGTTVYKNRALRTPFVKSGDNSTLRIEIDDPAVQAIEFLIFGETQNKWFKNNGQNFQIQLQSSRHQGNGASGASSSATSTLVPEDLVQIQAYLRWERKGKQSYTPEQEKEEYEAARAELIEELNRGVSLEKLRAKLTKTPEAPESDERKSPASRMPVDKLPEDLVQVQAYIRWEKAGKPNYPPEKQLVELEEARKELQAEVDKGISIDQLRQKILKGNIESKVSKQLKNKKYFSVERIQRKKRDIMQLLSKHKHTVMEEKVEVAPKQPTVLDLFTKSLHEKDGCEVLSRKLFKFGDKEILAISTKVQNKTEVHLATNHTEPLILHWSLAKKAGEWKAPPSNILPSGSKLLDMACETEFTRSELDGLCYQVVEIELDDGGYKGMPFVLRSGETWIKNNGSDFFLDFSTRDTRNIKLKDNGDAGKGTAKALLERIADLEEDAQRSLMHRFNIAADLADEARDAGLLGIVGLFVWIRFMATRQLTWNKNYNVKPREISKAQDRFTDDLENMYRTYPQYREILRMIMAAVGRGGEGDVGQRIRDEILVIQRNNDCKGGMMEEWHQKLHNNTSPDDVVICQALIDYIKNDFDISVYWDTLNKNGITKERLLSYDRAIHSEPNFRSEQKEGLLRDLGNYMRSLKAVHSGADLESAIATCMGYKSEGEGFMVGVQINPVKGLPSGFPELLEFVLDHVEDKSAEPLLEGLLEARVDLRPLLLDSPERMKDLIFLDIALDSTFRTAIERSYEELNDAAPEKIMYFISLVLENLAFSIDDNEDILYCLKGWNQALEMAKQKDDQWALYAKAFLDRIRLALASKGEQYHNMMQPSAEYLGSLLSIDKWAVNIFTEEIIRGGSAATLSALLNRFDPVLRNVANLGSWQVISPVEVSGYVVVVDELLAVQNKSYDKPTILVAKSVKGEEEIPDGVVGVITPDMPDVLSHVSVRARNSKVLFATCFDHTTLSELEGYDQKLLSFKPTSADITYREITESELQQSSSPNAEVGHAVPSISLAKKKFLGKYAISAEEFTEEMVGAKSRNIAYLKGKVPSWVGVPTSVAIPFGTFEKVLSDGLNKEVAQTIEKLKIRLAQEDFSALGEIRKAVLNLTAPMQLVNELKERMLGSGMPWPGDEGNRRWEQAWMAIKKVWASKWNERAYFSTRKVKLNHEYLSMAVLVQEVVNADYAFVIHTTNPSSGDSSEIYAEVVKGLGETLVGAYPGRAMSFVCKKDDLDSPKLLGYPSKPIGLFIRRSIIFRSDSNGEDLEGYAGAGLYDSVPMDEEDEVVLDYTTDPLIVDRGFRNSILSSIARAGHAIEELYGSPQDVEGVVKDGKIYVVQTRPQM

SEQ ID NO: 2 - protein, 1471 aa, Zea mays
  MISC_FEATURE (1)..(1471): ZmGWD protein
MSGFSAAANAAAAERCALAFRARPAASSPAKRQQQPQPASLRRSGGQRRPTTLSASSRGPVVPRAVATSADRASPDLIGKFTLDSNSELQVAVNPAPQGLVSEISLEVTNTSGSLILHWGALRPDKRDWILPSRKPDGTTVYKNRALRTPFVKSGDNSTLRIEIDDPGVHAIEFLIFDETQNKWFKNNGQNFQVQFQSSRHQGTGASGASSSATSTLVPEDLVQIQAYLRWERRGKQSYTPEQEKEEYEAARAELIEEVNRGVSLEKLRAKLTKAPEAPESDESKSSASRMPIGKLPEDLVQVQAYIRWEQAGKPNYPPEKQLVEFEEARKELQAEVDKGISIDQLRQKILKGNIESKVSKQLKNKKYFSVERIQRKKRDITQLLSKHKHTLVEDKVEVVPKQPTVLDLFTKSLHEKDGCEVLSRKLFKFGDKEILAISTKVQNKTEVHLATNHTDPLILHWSLAKNAGEWKAPSPNILPSGSTLLDKACETEFTKSELDGLHYQVVEIELDDGGYKGMPFVLRSGETWIKNNGSDFFLDFSTHDVRNIKAILKGNGDAGKGTAKALLERIADLEEDAQRSLMHRFNIAADLADQARDAGLLGIVGLFVWIRFMATRQLTWNKNYNVKPREISKAQDRFTDDLENMYKAYPQYREILRMIMAAVGRGGEGDVGQRIRDEILVIQRNNDCKGGMMEEWHQKLHNNTSPDDVVICQALIDYIKSDFDISVYWDTLNKNGITKERLLSYDRAIHSEPNFRSEQKAGLLRDLGNYMRSLKAVHSGADLESAIASCMGYKSEGEGFMVGVQINPVKGLPSGFPELLEFVLEHVEDKSAEPLLEGLLEARVELRPLLLDSRERMKDLIFLDIALDSTFRTAIERSYEELNDAAPEKIMYFISLVLENLALSIDDNEDILYCLKGWNQALEMAKQKDDQWALYAKAFLDRNRLALASKGEQYHNMMQPSAEYLGSLLSIDQWAVNIFTEEIIRGGSAATLSALLNRFDPVLRNVAHLGSWQVISPVEVSGYVVVVDELLAVQNKSYDKPTILVAKSVKGEEEIPDGVVGVITPDMPDVLSHVSVRARNSKVLFATCFDHTTLSELEGYDQKLFSFKPTSADITYREITESELQQSSSPNAEVGHAVPSISLAKKKFLGKYAISAEEFSEEMVGAKSRNIAYLKGKVPSWVGVPTSVAIPFGTFEKVLSDGLNKEVAQSIEKLKIRLAQEDFSALGEIRKVVLNLTAPMQLVNELKERMLGSGMPWPGDEGDKRWEQAWMAIKKVWASKWNERAYFSTRKVKLDHEYLSMAVLVQEVVNADYAFVIHTTNPSSGDSSEIYAEVVKGLGETLVGAYPGRAMSFVCKKDDLDSPKLLGYPSKPIGLFIRQSIIFRSDSNGEDLEGYAGAGLYDSVPMDEEDEVVLDYTTDPLIVDRGFRSSILSSIARAGHAIEELYGSPQDVEGVVKDGKIYVVQTRPQM

SEQ ID NO: 3 - protein, 1414 aa, Oryza sativa
  MISC_FEATURE (1)..(1414): OsGWD protein
PAATTTLAVSRRSLLAPRAIAASTGRASPGLVGRFTLDANSELKVTLNPAPQGSVVEINLEATNTSGSLILHWGALRPDRGEWLLPSRKPDGTTVYKNRALRTPFIKSGDNSTLKIEIDDPAVQAIEFLIFDEARNNWYKNNGQNFQIQLQASQYQGQGTSTATSSTVVPEDLVQIQSYLRWERKGKQSYTPEQEKEEYEAARTELIEELNKGVSLEKLRAKLTKTPEATDSNAPASESTVTTKVPEELVQVQAYIRWEKAGKPNYAPEKQLVEFEEARKELQSELDKGTSVEQLRNKILKGNIETKVSKQLKDKKYFSVERIQRKKRDIVQLLKKHKPTVMEAQVETPKQPTVLDLFTKSLQEQDNCEVLSRKLFKFGDKEILGITTVALGKTKVHLATNYMEPLILHWALSKENGEWQAPPSSILPSGSSLLDKACETSFSEYELNGLHCQVVEIELDDGGYKRMPFVLRSGETWMKNNGSDFYLDFSTKVAKNTKDTGDAGKGTAKALLERIADLEEDAQRSLMHRFNIAADLVDQARDNGLLGIIGIFVWIRFMATRQLIWNKNYNVKPREISKAQDRFTDDLENMYRTYPQYQEILRMIMSAVGRGGEGDVGQRIRDEILVIQRNNDCKGGMMEEWHQKLHNNTSPDDVVICQALLDYIKSDFDIGVYWDTLKKDGITKERLLSYDRPIHSEPNFRSEQKDGLLRDLGNYMRSLKAVHSGADLESAIATCMGYKSEGEGFMVGVQINPVKGLPSGFPKLLEFVLDHVEDKSAEPLLEGLLEARAELHPLLLGSPERMKDLIFLDIALDSTFRTAVERSYEELNNVEPEKIMYFISLVLENLALSTDDNEDILYCLKGWNQALEMAKQKNNQWALYAKAFLDRTRLALASKGEQYYNLMQPSAEYLGSLLNIDQWAVNIFTEEIIRGGSAATLSALLNRIDPVLRNVAQLGSWQVISPVEVSGYIVVVDELLAVQNKSYDKPTILVAKSVKGEEEIPDGVVGVITPDMPDVLSHVSVRARNCKVLFATCFDPNTLSELQGHDGKVFSFKPTSADITYREIPESELQSGSLNAEAGQAVPSVSLVKKKFLGKYAISAEEFSEEMVGAKSRNVAYLKGKVPSWVGVPTSVAIPFGTFEKVLSDEINKEVAQTIQMLKGKLAQDDFSALGEIRKTVLNLTAPTQLIKELKEKMLGSGMPWPGDEGDQRWEQAWMAIKKVWASKWNERAYFSTRKVKLDHDYLSMAVLVQEIVNADYAFVIHTTNPSSGDSSEIYAEVVKGLGETLVGAYPGRAMSFVCKKNDLDSPKVLGFPSKPIGLFIKRSIIFRSDSNGEDLEGYAGAGLYDSVPMDEEDEVILDYTTDPLITDQGFQKSILSSIARAGHAIEELYGSPQDVEGAVKEGKLYVVQTRPQM

SEQ ID NO: 4 - protein, 1464 aa, Solanum tuberosum
  MISC_FEATURE (1)..(1464): StGWD protein
MSNSLGNNLLYQGFLTSTVLEHKSRISPPCVGGNSLFQQQVISKSPLSTEFRGNRLKVQKKKIPMEKKRAFSSSPHAVLTTDTSSELAEKFSLGGNIELQVDVRPPTSGDVSFVDFQVTNGSDKLFLHWGAVKFGKETWSLPNDRPDGTKVYKNKALRTPFVKSGSNSILRLEIRDTAIEAIEFLIYDEAHDKWIKNNGGNFRVKLSRKEIRGPDVSVPEELVQIQSYLRWERKGKQNYPPEKEKEEYEAARTVLQEEIARGASIQDIRARLTKTNDKSQSKEEPLHVTKSDIPDDLAQAQAYIRWEKAGKPNYPPEKQIEELEEARRELQLELEKGITLDELRKTITKGEIKTKVEKHLKRSSFAVERIQRKKRDFGHLINKYTSSPAVQVQKVLEEPPALSKIKLYAKEKEEQIDDPILNKKIFKVDDGELLVLVAKSSGKTKVHLATDLNQPITLHWALSKSPGEWMVPPSSILPPGSIILDKAAETPFSASSSDGLTSKVQSLDIVIEDGNFVGMPFVLLSGEKWIKNQGSDFYVGFSAASKLALKAAGDGSGTAKSLLDKIADMESEAQKSFMHRFNIAADLIEDATSAGELGFAGILVWMRFMATRQLIWNKNYNVKPREISKAQDRLTDLLQNAFTSHPQYREILRMIMSTVGRGGEGDVGQRIRDEILVIQRNNDCKGGMMQEWHQKLHNNTSPDDVVICQALIDYIKSDFDLGVYWKTLNENGITKERLLSYDRAIHSEPNFRGDQKGGLLRDLGHYMRTLKAVHSGADLESAIANCMGYKTEGEGFMVGVQINPVSGLPSGFQDLLHFVLDHVEDKNVETLLERLLEAREELRPLLLKPNNRLKDLLFLDIALDSTVRTAVERGYEELNNANPEKIMYFISLVLENLALSVDDNEDLVYCLKGWNQALSMSNGGDNHWALFAKAVLDRTRLALASKAEWYHHLLQPSAEYLGSILGVDQWALNIFTEEIIRAGSAASLSSLLNRLDPVLRKTANLGSWQIISPVEAVGYVVVVDELLSVQNEIYEKPTILVAKSVKGEEEIPDGAVALITPDMPDVLSHVSVRARNGKVCFATCFDPNILADLQAKEGRILLLKPTPSDIIYSEVNEIELQSSSNLVEAETSATLRLVKKQFGGCYAISADEFTSEMVGAKSRNIAYLKGKVPSSVGIPTSVALPFGVFEKVLSDDINQGVAKELQILMKKLSEGDFSALGEIRTTVLDLSAPAQLVKELKEKMQGSGMPWPGDEGPKRWEQAWMAIKKVWASKWNERAYFSTRKVKLDHDYLCMAVLVQEIINADYAFVIHTTNPSSGDDSEIYAEVVRGLGETLVGAYPGRALSFICKKKDLNSPQVLGYPSKPIGLFIKRSIIFRSDSNGEDLEGYAGAGLYDSVPMDEEEKVVIDYSSDPLITDGNFRQTILSNIARAGHAIEELYGSPQDIEGVVRDGKIYVVQTRPQM

SEQ ID NO: 5 - DNA, 4410 bp, Sorghum bicolor
  misc_feature (1)..(4410): SbGWD coding sequence
atgaccggattcagtgccgcggcctccgcagcagcggcggcggagcggtgcgcgctcgcgatccgcgcacggcccgcggcctcctcgccagcgaagcggcagcagcagtcggcgtccctcagacgcagcgggggccagcgccgccccaccacgctcgctgcctcccgccgcagcccagtcgtcgtgccccgcgccatcgccacgtccgcggaccgcgcgtcccacgaccttgtcggaaagttcacgctggattccaactccgagctcctggttgcagtgaacccagcgccgcagggtttggtgtcggtgatcggcctggaggtgaccaacacaagcggttccctgattctgcattggggagtccttcgcccggacaagagagattggatcctcccatccagacaacctgatggaacgacggtgtacaagaacagggctcttaggacgccttttgtaaagtctggtgataactctactcttagaattgagatagatgatcctgcggtgcaagctattgagttcctcatctttggcgagacacagaacaaatggtttaaaaacaatggccagaattttcagattcagctccagtcgagccgccatcagggtaatggtgcatctggtgcctcctcttctgctacttctaccttggtgccagaggatcttgtgcagatccaagcttaccttcggtgggaaagaaagggaaagcagtcatacacaccagagcaagaaaaggaggagtatgaagctgcacgagctgagttaatagaggaattaaatagaggtgtttctttagagaagcttcgagctaaattgacaaaaacacctgaagcacctgagtcagatgaacgtaaatctcctgcatctcgaatgcccgttgataaacttccagaggaccttgtacaggtgcaggcttatataaggtgggagaaagcgggcaagccaaattatcctcctgagaagcaactggtagaacttgaggaagcaaggaaggaactgcaggctgaggtggacaagggaatctctattgatcaattgaggcagaaaattttgaaaggaaacattgagagtaaagtttccaagcagctgaagaacaagaagtacttctctgtagaaaggattcagcgcaaaaagagagatatcatgcaacttctcagtaaacataagcatacagttatggaagagaaagtagaggttgcaccaaaacaaccaactgttcttgatctcttcaccaagtctttacatgagaaggatggctgtgaagttctaagcagaaagctcttcaagttcggtgataaagagatactggcaatttccaccaaggttcaaaataaaacagaagttcacttggcaacaaaccatacggagccacttattcttcactggtctttggcaaaaaaggctggagaatggaaggcacctccttcaaatatattgccatctggttccaaattgctagacatggcgtgtgaaactgaatttactagatctgaattggatggtttgtgttaccaggttgttgagatagagcttgatgatggaggatacaaaggaatgccatttgttcttaggtctggtgaaacatggataaaaaataatggttccgattttttcctagatttcagcacccgtgataccagaaatattaagttaaaggacaatggcgatgctggtaaaggcactgctaaggcgttgctggagagaatagcagatctggaggaagatgcccagcgatctcttatgcataggttcaatattgcagcagatctagctgacgaagccagagatgctggactgttgggtattgttggactttttgtttggattaggttcatggctaccaggcaactaacatggaataagaactataatgtgaagccacgtgagataagcaaagcacaagataggtttacagatgatcttgagaatatgtacagaacttatcctcagtacagagagatactaagaatgataatggctgctgttggtcgtggaggtgaaggtgacgttggtcaacgcattcgtgatgagatattagtaatacagagaaataatgactgcaaaggtggaatgatggaagaatggcaccagaaattgcacaacaatacaagcccagatgatgtagtgatatgccaggcattaattgattatataaaaaatgattttgatataagcgtttactgggacaccttgaacaaaaatggcataaccaaagagcgtctcttgagctatgatcgtgctattcattcagaaccaaatttcagaagtgaacagaaggagggtttactccgtgacctgggaaattacatgagaagcctaaaggctgtgcattctggtgctgatcttgaatctgctatagcaacttgtatgggatacaaatcagagggtgaaggtttcatggttggcgttcagatcaatccagtgaagggtttgccatctggatttcctgagttgcttgaatttgtgcttgaccatgttgaggataaatcagcagaaccacttcttgaggggctattggaagctcgagttgatctgcgccctttgcttcttgattcgcctgaacgcatgaaagatcttatatttttggacattgctcttgattctaccttcaggacagcaattgaaaggtcatatgaggagctcaatgatgcagccccagagaaaataatgtacttcatcagtcttgtccttgaaaatcttgcgttttcaattgacgacaatgaagacatcctgtattgcttaaagggatggaaccaagccttggaaatggctaagcaaaaagacgaccaatgggctctttacgctaaagcatttcttgacagaatcagacttgcccttgcgagcaagggagaacagtaccataatatgatgcagccctcagctgaatatcttggctcgttactcagcatagacaaatgggcagtcaatatcttcacagaagaaattatacgcggtggatcagctgctactctgtccgctcttctgaaccgatttgatcctgttctaaggaacgttgctaaccttggaagttggcaggttataagcccagttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtcccatgtgtcagtccgagcaaggaatagcaaggtactgtttgcaacctgttttgaccataccactctgtctgaacttgaaggatatgatcagaaactgctttccttcaagcctacttctgcagatataacctatagggagatcacagagagtgagcttcagcaatcaagttctccaaatgcagaagttggccatgcagtaccatctatttcattggccaagaagaaatttcttggaaaatatgcaatatcagctgaagaattcaccgaggaaatggttggggccaagtctcggaatatagcatacctcaaaggaaaagtaccttcatgggttggtgttccaacgtcagttgcgataccatttggcacttttgagaaggttttgtcagatggtcttaataaggaagtagcacaaaccatagagaagcttaagatcaggcttgctcaagaagattttagtgctctaggtgaaataagaaaagccgttcttaatcttactgctcctatgcaattggttaatgagctgaaggagaggatgctaggctctggaatgccctggcctggtgatgaaggcaacaggcgctgggagcaagcatggatggctattaaaaaggtttgggcatcaaaatggaatgaaagagcatattttagcacacgcaaggtgaaactcaatcatgagtacctttcgatggctgttcttgtgcaagaagttgtgaatgcagattatgcttttgtcattcatactacaaacccatcgtctggagattcttctgagatatatgctgaagtcgtgaaagggctcggagagactctcgtgggagcctatcctggtcgtgctatgagctttgtttgcaaaaaagatgaccttgactctcccaagttacttggttacccgagcaagccaattggtctcttcataaggcgatcgatcatctttcgttctgactccaacggcgaggatctggaaggttatgccggagcaggattatatgatagtgtaccgatggatgaggaggatgaagtcgtacttgattacacaactgaccctcttatagtagatcgtggattccgaaattcaatactctcaagcatcgcacgggctggccatgccattgaagagctatatggttctcctcaggacgtcgagggtgtagtgaaggatggaaaaatctatgtagtccagacaagaccacagatgtag

SEQ ID NO: 6 - DNA, 4416 bp, Zea mays
  misc_feature (1)..(4416): ZmGWD coding sequence
atgtccggattcagtgccgcggccaacgcagcggcggctgagcggtgcgcgctcgcgttccgcgcacggcccgcggcctcctcgccagcgaagcggcagcagcagccgcagccagcgtccctccgacgcagcgggggccagcgccgccccacgacgctctccgcctctagccgcggccccgtcgtgccgcgcgccgtcgccacgtccgcggaccgcgcgtcccccgaccttatcggaaagttcacgctggattccaactccgagctccaggtcgcagtgaacccagcgccgcagggtttggtgtcagagattagcctggaggtgaccaacacaagcggttccctgattttgcattggggagcccttcgcccggacaagagagattggatcctcccgtccagaaaacctgatggaacgacagtgtacaagaacagggctctcaggacaccttttgtaaagtcaggtgataactccactctaaggattgagatagatgatcctggggtgcacgccattgagttcctcatctttgacgagacacagaacaaatggtttaaaaacaatggccagaattttcaggttcagttccagtcgagccgccatcagggtactggtgcatctggtgcctcctcttctgctacttctaccttggtgccagaggatcttgtgcagatccaagcttaccttcggtgggaaagaaggggaaagcagtcatacacaccagagcaagaaaaggaggagtatgaagctgcacgagctgagttaatagaggaagtaaacagaggtgtttctttagagaagcttcgagctaaattgacaaaagcacctgaagcacctgagtcggatgaaagtaaatcttctgcatctcgaatgcccatcggtaaacttccagaggatcttgtacaggtgcaggcttatataaggtgggagcaagcgggcaagccaaactatcctcctgagaagcaactggtagaatttgaggaagcaaggaaggaactgcaggctgaggtggacaagggaatctctattgatcagttgaggcagaaaattttgaaaggaaacattgagagtaaagtttccaagcagctgaagaacaagaagtacttctctgtagaaaggattcagcgcaaaaagagagatatcacacaacttctcagtaaacataagcatacacttgtggaagataaagtagaggttgtaccaaaacaaccaactgttcttgatctcttcaccaagtctttacatgagaaggatggctgtgaagttctaagcagaaagctcttcaagttcggcgataaagagatactggcaatttctaccaaggttcaaaataaaacagaagttcacttggcaacaaaccataccgacccacttattcttcactggtctttggcaaaaaatgctggagaatggaaggcaccttctccaaatatattgccatctggttccacattgctggacaaggcgtgtgaaactgaatttactaaatctgaattggatggtttgcattaccaggttgttgagatagagcttgatgatggaggatacaaaggaatgccatttgttcttcggtctggtgaaacatggataaaaaataatggttctgattttttcctagatttcagcacccatgatgtcagaaatattaaggcaattttaaagggcaatggtgatgctggtaaaggtactgctaaggcattgctggagagaatagcagatctggaggaagatgcccagcgatctcttatgcacagattcaatattgcagcagatctagctgaccaagccagagatgctggacttttgggtattgttgggctttttgtttggattagattcatggctaccaggcaactaacatggaataagaactataatgtgaagccacgtgagataagcaaagcacaggataggtttacagatgatcttgagaatatgtacaaagcttatccacagtacagagagatattaagaatgataatggctgctgttggtcgcggaggtgaaggtgatgttggtcaacgcattcgtgatgagatattagtaatacagagaaataatgactgcaaaggtggaatgatggaagaatggcaccagaaattgcacaacaatacaagcccagatgatgtagtgatatgccaggccttaattgattatatcaagagtgactttgatataagcgtttactgggacaccttgaacaaaaatggcataaccaaagagcgtctcttgagctatgatcgtgctattcattcagaaccaaatttcagaagtgaacagaaggcgggtttactccgtgacctgggaaattacatgagaagcctaaaggctgtgcattctggtgctgatcttgaatctgctatagcaagttgtatgggatacaaatcagagggtgaaggtttcatggttggtgttcagatcaatccagtgaagggtttaccatctggatttccggagttgcttgaatttgtgcttgaacatgttgaggataaatcagcggaaccacttcttgaggggctattggaagctcgagttgaactgcgccctttgcttcttgattcgcgtgaacgcatgaaagatcttatatttttggacattgctcttgattctaccttcaggacagcaattgaaaggtcatatgaggagctgaatgatgcagccccagagaaaataatgtacttcatcagtcttgtccttgaaaatcttgcgctttcaattgacgacaatgaagacatcctgtattgtttaaagggatggaaccaagccttggaaatggctaagcaaaaagacgaccaatgggcgctctatgctaaagcatttcttgacagaaacagacttgcccttgcgagcaagggagaacaataccataatatgatgcagccctctgctgagtatcttggctcgttactcagcatagaccaatgggcagtcaatatcttcacagaagaaattatacgcggtggatcagctgctactctgtctgctcttctgaaccgatttgatcctgttttaaggaatgttgctcacctcggaagttggcaggttataagcccggttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtctcatgtgtcagtccgagcaaggaatagcaaggtactgtttgcgacctgttttgaccacaccactctatctgaacttgaaggatatgatcagaaactgttttccttcaagcctacttctgcagatataacctatagggagatcacagagagtgaacttcagcaatcaagttctccaaatgcagaagttggccatgcagtaccatctatttcattggccaagaagaaatttcttggaaaatatgcaatatcagccgaagaattctctgaggaaatggttggggccaagtctcggaatatagcatacctcaaaggaaaagtaccttcatgggtcggtgtcccaacgtcagttgcgataccatttggcacttttgagaaggttttgtcagatgggcttaataaggaagtagcacagagcatagagaagcttaagatcagacttgcccaagaagattttagtgctctaggtgaaataagaaaagtcgtccttaatcttactgctcctatgcaattggttaatgagctgaaggagaggatgctaggctctggaatgccctggcctggtgatgaaggagacaagcgttgggagcaagcatggatggctattaaaaaggtttgggcatcaaaatggaacgaaagagcatattttagcacacgcaaggtgaaacttgatcatgagtacctttcgatggctgttctcgtgcaagaagttgtgaatgcagattatgcttttgtcattcataccacaaacccatcgtctggagattcttctgagatatatgctgaagtggtgaaagggcttggcgagaccctcgtgggagcctatcctggtcgtgctatgagctttgtttgcaaaaaagatgaccttgactctcccaagttacttggttacccaagcaagccaattggtctcttcataaggcaatcaatcatcttccgttccgactccaacggtgaggacctggaaggttatgctggagcaggattatatgatagtgtaccgatggatgaggaggatgaggttgtacttgattatacaactgaccctcttatagtagaccgtggattccgaagctcaatcctctcaagcatagcacgggctggccatgccatcgaggagctatatggttctcctcaggacgtcgagggagtagtgaaggatggaaaaatctatgtagtccagacaagaccacagatgtag

SEQ ID NO: 7 - DNA, 4359 bp, Oryza sativa
  misc_feature (1)..(4359): OsGWD coding sequence
atggcgctaaggaaggagagatatccatccggatcccggaagccgaatccatccatccatccatcccatactgcccttacgatcgagctgtttgatattcgtgcagatgagcggattctccgcggcagctgctgcggccgagcgcttgtcggaaggttcaccctggatgccaactccgagcttaaggtgacattgaacccagcaccgcagggttcggtggtggagatcaatctagaggcaactaacaccagcggctccctgatactgcattggggcgcccttcgcccggatagaggagaatggctcctaccatcccggaaaccagatggcacgacagtgtacaagaacagggctcttaggacgccttttataaagtcaggtgataactccacgctgaaaattgagatagatgatcctgcagtgcaagccattgagttcctcatatttgatgaggcacggaataattggtcagttctttttgggttacccatcctaccctgtttcttggaatgcagaagatatcaaataacaacactctactttggacaggaggagtatgaagcagcacgaactgagttgatagaggaattaaacaagggtgtttctttggagaagctacgagcgaaactgacaaagacacctgaggcaactgatagtaatgctcctgcatctgaaagcactgtgactactaaagtcccagaggaacttgtacaagtccaggcttacataaggtgggagaaagcaggcaagccaaattatgccccagagaagcaattggtcgagtttgaggaagcaaggaaggaactgcagtctgagttggataaggggacctcagttgagcagttgaggaacaaaattttgaaagggaacattgagacaaaagtttccaagcagctgaaggacaaaaaatacttttctgtggaaagaattcagcggaaaaaacgagatattgtgcaactacttaaaaaacacaagcctactgttatggaagcgcaagtagagactcctaaacaacccactgttctggatctcttcacaaagtcattacaggagcaggataactgtgaggttctaagcagaaagcttttcaagttcggtgacaaggagatactggaaaaaccaaagttcacttggcaacaaactatatggagccacttatacttcactgggcgttgtcaaaagagaatggagagtggcagacaatgtgggcctgtactgatggggtgctttgtaactgtgaaggcacctccctcaagcatattgccatctggttcatcattgctagacaaggcatgtgaaacttcattcagtgaatatgaattgaatggtctgcattgtcaggatactggtgatgctggtaaaggcactgctaaggccttgcttgaaagaatagcagatctagaggaagatgcccaacgatctcttatgcacagattcaatattgcagcagatctagttgaccaagcaagagataatggattattgggtattattggaatttttgtttggattaggttcatggctacaaggcaactaatatggaacaagaactacaatgtgaagccacgtgagataagcaaagcacaagataggtttacagatgatcttgagaatatgtacagaacttacccacaatatcaggagatcttaagaatgataatgtctgctgttggtcggggaggtgaaggtgatgttggtcaacgcattcgtgatgagatattagtaatccagagaaataatgactgcaaaggtggaatgatggaggagtggcaccagaaactgcacaacaatacaagcccagatgatgtagtgatctgccaggccctacttgattatatcaagagtgattttgatattggtgtttactgggacaccttgaaaaaagatggtataacaaaagagcgtctattgagctatgatcgaccgattcattcagagccaaatttcaggagtgaacagaaagatggcttactccgtgacttgggcaattatatgagaagcctcaagatggagggtaccctgatacaatcactgcgaatggcagtgcattctggtgctgatcttgaatctgctatagcaacttgcatgggatacaaatcagagggtgaaggtttcatggttggtgttcagattaatccagtgaagggtttgccatctggatttcctaaattgcttgaatttgtacttgaccatgttgaggataaatcagcagaaccacttcttgaggggttattggaggctcgagctgaactacaccctttgctccttggctctcctgaacgcatgaaggatcttatctttttagacattgctcttgattctactttcaggacagcagttgaaagatcatatgaggagctcaataatgtagaaccagagaaaattatgtacttcatcagtcttgtccttgaaaatcttgctttatccaccgacgacaatgaagatatcctatattgcttaaagggatggaatcaagccttggaaatggctaaacagaaaaacaaccaatgggctctctatgctaaagcatttctggacagaaccagacttgcccttgcaagcaagggagaacaatactataatttgatgcagccctcagctgaatatcttggctcgttacttaacattgaccaatgggcagttaatatctttacagaagaaattattcgtggtggatcagctgctaccctgtctgctcttctgaatcggattgatcctgttcttaggaatgttgcacagcttggaagttggcaggttataagcccagttgaagtatcaggttacattgtagtggttgatgaattgcttgctgttcaaaacaaatcctatgataaaccaactatccttgtggcaaagagtgtcaagggagaggaagaaataccagatggagttgttggtgttattacacctgatatgccagatgttctctcccatgtatcagtccgagcaaggaattgcaaggttttatttgcaacatgctttgatcctaacaccttgtctgaactccaaggacatgatgggaaagtgttttccttcaaacctacttctgcagatatcacctatagggagattccagagagtgaactgcaatcaggttctctaaatgcagaagctggccaggcagtgccatctgtgtcattagtcaagaagaagtttcttggaaaatatgcaatatcagcagaagaattctctgaggaaatggttggggccaagtctcgcaacgtagcatacctcaaaggaaaagtaccctcatgggttggtgtccctacatcagttgcgattccatttgggacctttgagaaggttttgtctgatgaaatcaataaggaagtcgcgcaaaccatacaaatgctgaagggaaaacttgctcaagatgattttagtgctctaggcgaaatacggaaaactgttctcaatttaactgctcctactcaactgatcaaggaactgaaggagaagatgctaggctctggaatgccctggcctggagatgaaggtgaccaacgttgggagcaagcatggatggcaattaaaaaggtttgggcgtcaaaatggaatgaaagagcatattttagcactcgtaaggtgaagcttgatcatgactacctttccatggctgtacttgtacaagaaattgtcaatgcagactatgcctttgtcattcatactactaacccatcatcgggagattcgtctgagatatatgctgaagtggtgaaagggcttggagaaacacttgtaggagcctatcctggtcgcgccatgagctttgtatgtaagaaaaacgaccttgactctcccaaggtactgggtttcccaagcaagccaattggtctcttcataaagagatcaatcatctttcgttcagattccaacggtgaggatttagaagggtatgctggagcaggactgtatgatagttcgctcaagaatttatttggcattacaactaagctgactgcttgtttcagtgtccctatggatgaggaagatgaagtcatactcgactacaccaccgaccccctcattacagatcagggattccaaaaatctatcctctcgagcattgcacgggctggtcatgccattgaggagctttatgggtccccacaggatgttgagggtgcagtgaaggaagggaagctatacgtagtacagacaagaccacagatgggaaaagccagggaggactactaccaagtgctgggagtgacggttaattcaacgcctcaggagatcaaggaggcttacaggaagctccagaaacgacaccatatcctgatattgctggctacaagggtcatgcatgactacaccctactgctgaatgaggcatacaaggtattgatgaggaattaa

SEQ ID NO: 8 - DNA, 12128 bp, Sorghum bicolor
  gene (1)..(12128): SbGWD gene
atgaccggattcagtgccgcggcctccgcagcagcggcggcggagcggtgcgcgctcgcgatccgcgcacggcccgcggcctcctcgccagcgaagcggcagcagcagtcggcgtccctcagacgcagcgggggccagcgccgccccaccacgctcgctgcctcccgccgcagcccagtcgtcgtgccccgcgccatcgccacgtccgcggaccgcgcgtcccacgacgtaagcacctcttgtctgctctatctttcgccgttgggccatcatcagctaatgcgctcccacactgtttggcaatttgcccgcttgattttccttttttttttccgttgctcttatcgcagcttgtcggaaagttcacgctggattccaactccgagctcctggtgcggccgcgggattccaggttcattcaccatttgttacgaattttatctctgtaacattattggtgcattgtgtgggaacaggttgcagtgaacccagcgccgcagggtttggtgtcggtgatcggcctggaggtgaccaacacaagcggttccctgattctgcattggggagtccttcgcccggacaagaggtgagaggcactgcttctcttgccgtttttttggcaaaatatgagtcaaacatgctcttatgccatttgctgcagtcgaagcttctcttgccgcttttgataacagaatatgagtcacacaaaggctcttgtgccatttgctgcactttcttttagattgaatttgatatacctgagctccttggctgcagagattggatcctcccatccagacaacctgatggaacgacggtgtacaagaacagggctcttaggacgccttttgtaaaggtcagtcgtcctgcatcaatgatctttgtgctaccacggaacagtagttactaatgtctataactgtgcagtctggtgataactctactcttagaattgagatagatgatcctgcggtgcaagctattgagttcctcatctttggcgagacacagaacaaatggtaatgctgctgtttggattactgtgtaccactgcgtgagtgcttgtttatttgaatgcacaagatatcaaccatctgaactctactttggacaggtttaaaaacaatggccagaattttcagattcagctccagtcgagccgccatcagggtaatggtgcatctggtgcctcctcttctgctacttctaccttggtgccagaggatcttgtgcagatccaagcttaccttcggtgggaaagaaagggaaagcagtcatacacaccagagcaagaaaaggcaagcttttagtactaaacttttcatcgtccatccggaaggaacttgatgcactaagttattagttagctaaagataggtagctgttgcatttttctccaggaggagtatgaagctgcacgagctgagttaatagaggaattaaatagaggtgtttctttagagaagcttcgagctaaattgacaaaaacacctgaagcacctgagtcagatgaacgtaaatctcctgcatctcgaatgcccgttgataaacttccagaggaccttgtacaggtgcaggcttatataaggtgggagaaagcgggcaagccaaattatcctcctgagaagcaactggtaatacattgattcaacagcgtaaaatagcttgttggcttaacgcttcatggaggttcttatttcataatttgctaggtagaacttgaggaagcaaggaaggaactgcaggctgaggtggacaagggaatctctattgatcaattgaggcagaaaattttgaaaggaaacattgagagtaaagtttccaagcagctgaagaacaagaagtacttctctgtagaaaggattcagcgcaaaaagagagatatcatgcaacttctcagtaaacataagcatacagttatggaagagaaagtagaggttgcaccaaaacaaccaactgttcttgatctcttcaccaagtctttacatgagaaggatggctgtgaagttctaagcagaaagctcttcaagttcggtgataaagagatactggttaggatccttgacagattctttgcatttcccgcccttgcttccaccaggctaattaagcttctcccttcttaaggcaatttccaccaaggttcaaaataaaacagaagttcacttggcaacaaaccatacggagccacttattcttcactggtctttggcaaaaaaggctggagaatggaaggtaaaaccccaaaatcttttccattttttaaagctgcaagaagctgtattaaacactgttatcagtgccaatgcggtgttatttaactgtgcaggcacctccttcaaatatattgccatctggttccaaattgctagacatggcgtgtgaaactgaatttactagatctgaattggatggtttgtgttaccaggtggaactaacaccgtcaacttgttttaattccctctttatattagccgtcttgccatctcaaggttcttattgtccaggttgttgagatagagcttgatgatggaggatacaaaggaatgccatttgttcttaggtctggtgaaacatggataaaaaataatggttccgattttttcctagatttcagcacccgtgataccagaaatattaaggcaattgcttctgtccactttaccttgcaaacttcatactgcttcttctgctttgactgttttacagtctcttacttgtaaaactctccaatttgttcttagttaaaggacaatggcgatgctggtaaaggcactgctaaggcgttgctggagagaatagcagatctggaggaagatgcccagcgatctcttatgcataggtcaggcactaaattatccataatgatatgactgcctttttcatggaaagttctcctaaactacttctttcttcaacaggttcaatattgcagcagatctagctgacgaagccagagatgctggactgttgggtattgttggactttttgtttggattaggttcatggctaccaggcaactaacatggaataagaactataatgtgaagccacggtatatacctgtttttattatttacttaagtaaccttttactctctgtttaaaataatcagaaattgtccttttcttttggcatgcgaacctaatttgactgttggtcatcataaatgacaaaacagtatacaattaatagttgtagaatattgtatagatacaaacaaaaacataactctcataatgttcaataaccatgcagtgagataagcaaagcacaagataggtttacagatgatcttgagaatatgtacagaacttatcctcagtacagagagatactaagaatgataatggctgctgttggtcgtggaggtgaaggtgacgttggtcaacgcattcgtgatgagatattagtaatacaggtaaaactgatggtccttggtgaatatacagttattttcgttcattgctctgctgaattgagcagttggtagtgctcatccaaaacgtagacattgtcaacaataaaatgtttggtgtgttacagagaaataatgactgcaaaggtggaatgatggaagaatggcaccagaaattgcacaacaatacaagcccagatgatgtagtgatatgccaggtattggatgcttcgaattcttaatactgcaaaatttaggctttgaggttttgacggtttcatctctccttgggcaggcattaattgattatataaaaaatgattttgatataagcgtttactgggacaccttgaacaaaaatggcataaccaaagagcgtctcttgagctatgatcgtgctattcattcagaaccaaatttcagaagtgaacagaaggagggtttactccgtgacctgggaaattacatgagaagcctaaaggtatgtgacacagctaatatggataataaaaggtaggggaaaattgtgccttatgtttgaaatgagtatagttttgcaaagacaacatatgaaaacacatattgtgctatcaattcagaaaaaaaggataaaaaaatatacagacaaattgtatactagtttacctttttctgctaatggtatatgctgttctgtccagtatatgctttcaatagtaatatttctagctttgacaatgtgcaaaaaccctggtatgcccattactgtatgaacttgtccttgagtctcctcattttttccttatccatataacagcttatccttgaatctccagtgaaacctcctgattttaaccaatttcaatgtaaaaaaaaaatccatatctttgcctttatacattttctttatgagaaaagagtgaaacaaacacagttctaaaatcaggtaagaacttccaaataatttttcacttctaatctattgatgtgcagctctcctatgtttttcgagaaaaaaaaccctcaaaataatttaacagtttgatgtatggtgctagaatcatatagttagttgctaatcatcgcattgtgttcaatctagcaccgactcccagttgcagtagatcaaattattttacctttttttggtcaaacataagtgataaatacagttattcgtttttttaaaaaaactatataattccctcatttttagatttctctgcttgatgctattattggaaaaaacaccccatctcatatatatctaaggaaatttccaggggctaacttttgtgttctttgctgaggcatacttattcgattgcatagctggccaagttaacatagacatgtgatgtttatttattaatttcatttatgtcattgtgatccttcttctacagccagcacaacaagaaggctacctcagctagccacgccgagtaggtcaaccagttagctgctggctattttgcttgatggttaagttagtgaagggatcagataataaggattgttagggccttatgggtttgtttcaggttggtttattaggatattagttagtgctacccttgctctataaaaggggatttgcttttcttgaataaagcatgcagaattaaattgaatccttctccctcttcgatttctaccttgctgttgcagccatgctgatgtggtctagggccacatcctctggtcgaccatacctatggcctaagttctaattcactctaagacagctaagctagtgagaataaatatgatgctgtcccaattatgctagtgcatgattttcttatggcttgccattcgaaataaatgctggacagcagatagatcagcacaaagaggcctcccttatccaggacaagtgtgtgctgtgtgaccaagatgaagaatcagtccagcacatcctctccacttgtgtatttgcttgacagttctgaactgttagaacgccttggtcttgaaagagttgcaccccgatacaatgaactgagatttgcagattggtggaggaagacaagtcagaagatagaaaagacaaggaaaaaggggtttaactgtgttgtgattttgggtgcttggacactttggattcagagtaacaaatgtgtctttgatggcgcctctcctctcagagatgctcaataatacttttaggaagagatgagaatgtggagtatggctggagcatgaaagctccaagagttggtcgttcttccctagtaataggcgatttgtctcacgttcttttgttgcaacctgcccttgacatcctgttggttcaaggggtgattggtatatacccctgacttctttttgggttaagggtggtgtgtgtttcttttgttgggcagttttttcctctctatatataaagatgtgcagttctcctgtgcactcgagaaaagtcactgtttgcctagtggagtgtctggatcgtctatatgacacttagatcctaattgagacccaagtctggcttctaggaagtatggatgtgcaattagaacttagattctgattagttaagattaatcactagccgtgaagtggtcgtttgtctagtgtgttgtgtagataatactggtcacgttgtaacttttttttgtgacaaaaaaagaagatatacatttactcatcttttctgtgattgaatgttctttccctgacataatgtttgattaatgctattatgtttttctcattctgttaggctgtgcattctggtgctgatcttgaatctgctatagcaacttgtatgggatacaaatcagaggtatcatcctcatccctgtttgttctgctacaatgctttacatacctgtgctcatttctaatgaactaactttttggatacagggtgaaggtttcatggttggcgttcagatcaatccagtgaagggtttgccatctggatttcctgtaaaaatctctcaactccttttcgcaaaacatgtaccttcatagtttcttacatttgtgacatttactgcctggtacaggagttgcttgaatttgtgcttgaccatgttgaggataaatcagcagaaccacttcttgaggtcagtgataatagatccaagttcatggtttctaataaaacaaagagcagatgctaggattcattgtctcaattcaaacagctagatctccataactgactgaattctttagtgcatccatttttgtggttttgctttgtggatcagttattgacaacaaattgttaacttataggggctattggaagctcgagttgatctgcgccctttgcttcttgattcgcctgaacgcatgaaagatcttatatttttggacattgctcttgattctaccttcaggacagcaattgaaaggtcatatgaggagctcaatgatgcagccccagaggttggtcaccagaagtattgctatagaagacattattaaatgcaccttttcccgtatcgcatgttgcttttagctttttccaaatgcattatctcatgatgccctttttctcaatccagaaaataatgtacttcatcagtcttgtccttgaaaatcttgcgttttcaattgacgacaatgaagacatcctgtattgcttaaaggtacacttcgagtctttattatccagaaatacaaagatttttatagtggagtttacattattttgtgaattaataatcaaattgatatgcatgtcctaatctagttgtttatgtagattagatagactctgcaaatttcatttttcttgttttctatttcttgtttcttgaccatgtgcctttcttaaaaatgttttctccaaaatctctagaaaattattcatattttgatatacttcaaataagtaccatgccaaaatttgctaacgaaaagacgcagatagagcactattaagtaataccatactgctgttgaaatccttactttgatcactgcaagtaagaggggaatgttatttgcctcagcatggtcattaacaagtagtgtatgaactctgtcctatatattttgatactacattttagtgacagctattaattttgttgtattatggatttacatttcattttttgtgtgcctttagcactttgttattattcagcacattaaacacatggatggtcaaagtttcaactgtttgaatcacatggatacagaagtgacacttgttttacgagggcatttgtgctatctagaaacaattgtttgtttgaacttatttgtgattctattttgtgatgcttaacaatggtgatgttgtctaaatgtttttttcctgaagggatggaaccaagccttggaaatggctaagcaaaaagacgaccaatgggctctttacgctaaagcatttcttgacagaatcagacttgcccttgcgagcaagggagaacagtaccataatatgatgcagccctcagctgaatatcttggctcgttactcagcatagacaaatgggcagtgagtacttcatagaaatcaaatctaatgttccatttgttcatcaagaaattaataataaatatcactttttttcaggtcaatatcttcacagaagaaattatacgcggtggatcagctgctactctgtccgctcttctgaaccgatttgatcctgttctaaggaacgttgctaaccttggaaggtaaaaatgtaaaatctatgactactgttgaacttcttacattgtctccccggtaaatgaacacataattctaaaagtggtactagtgacctctccacagttttatgtgaaccacagaaattaaatatgataatatattctattactctgcacctgacatctggctcctgataacagttggcaggttataagcccagttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtcccatgtgtcagtccgagcaaggaatagcaaggtttattttcacagttatgttgcaagctttctcagattttttttcttgtatcgatgttgacataccagttttttcctaatgatgaaggtactgtttgcaacctgttttgaccataccactctgtctgaacttgaaggatatgatcagaaactgctttccttcaagcctacttctgcagatataacctataggtacttgaggttatttgaacttcattcatgtctaatgaagctaggttataaaggctaataactaattattttttaatatttccttccatcagcttgttcattcatttggtaacttagatccatacatccatacatattgatattttgaaagacaattttgggttgtttttcctaaaatatgcagtgtatcattgcattaacaaaggaaattgaaaaggtaccacgcaaacacactaccacgaaaacaacacacttgcaacacctacattaaccaggtccagggattccaacgtgcaacactgaataaaaataaagaaagcaactaaagtaatttttgtgttgttattaatgacatacaggatatgtctataggggtaatataggggtgtttggttctccgccgacgtaagccacgccatagactgtggtggcggttctgtggctgctgcttggttcctgtcaaaactgtggctgccactactactcccagcacaaaataacaccacacctgtgcgctgaaattcggcgcctaaccttcggtgccgccgttgttgcggcatggcaacccatggccaggaaccaagcagacccacaatcttcttctgtgtaaacgacaagtgtctatatacctgcctaattatcaccgtgtttgagaaaaaaaaacttcatactttacacaatttatatggtcaagctacacttgatggcacaccatcaactttggccaatatctgactgagtggtcccatgttaccaacatttcacagctgatctggtattatctgttacatgctcacatctcatatcttgcattcaatagggagatcacagagagtgagcttcagcaatcaagttctccaaatgcagaagttggccatgcagtaccatctatttcattggccaagaagaaatttcttggaaaatatgcaatatcagctgaagaattcaccgaggaaatggtacataatataaacttttgcataaggagttcttttcattgaaaagaaaagctttgatgaaaccagctgttagtatgctggttttcttttcttttggccttgtgcttatgctcacatttctattttcaggttggggccaagtctcggaatatagcatacctcaaaggaaaagtaccttcatgggttggtgttccaacgtcagttgcgataccatttggcacttttgagaaggttttgtcagatggtcttaataaggtcagtttctggttcttttttaacattatacttgaacaatagcgctatatatttgttggagaagtctgtttctttaaaatacactattgggaagctatcaatgtgcacttaaatgtccaccaatttctaaggggccattttggtattcaaaacaccaatgcattttttcagagcctgctctgtaagtagcatcttcagtagtatgtatttcatagctttatattctcattctaccatgaactctaattttctaaagctaaactacatatacgcttgaaataagctatgatgttattatctttgatggtaaatgaccctaccatgctcatcggaaggtgtctttagacaggaacaaagcaaatgataacaagaagcctcttcttagggatttgttgtgcagtttgaactagtgttctccccccccccccccccccctctttttcctcgaatatgcaggagagctgcgtatcattgtattaagagaggaaaaaacggtcctgtataattgtactccctactctgcgctgagctgtaggagggtcctaaaacatagtttttctaaccgataaaagcacacactctaggtgagacctgaccaatgctgtaacccccttgttctgtcttttttttttgtttctttctttttcttttctacggtttccttataaaaaaaatatcagttggggaccctctgctgtttcatcaaaaacgatctgccttatattccattgttcttttatggcaggaagtagcacaaaccatagagaagcttaagatcaggcttgctcaagaagattttagtgctctaggtgaaataagaaaagccgttcttaatcttactgctcctatgcaattggtaagatatctctatattcttatatttgttgcaattaagacttaattatgacattgatctttttattattccatgtatgccttattttgtgtctcaggttaatgagctgaaggagaggatgctaggctctggaatgccctggcctggtgatgaaggcaacaggcgctgggagcaagcatggatggctattaaaaaggtaccctcatctacaattaatactagtaattgatccataagtttcggcatatccttgtaggtcattagcttaggaacaccaggggctttaacttttaagttgtacctctttgcctttattcgtggggtcacttgatcccacagattgtagatagatcgattacaagtaagcaatatgcatggaaaattgaatctaagaaaatatttttcctagtatgatcattgtatatctcaatttcctttttaggtttgggcatcaaaatggaatgaaagagcatattttagcacacgcaaggtgaaactcaatcatgagtacctttcgatggctgttcttgtgcaagaagttgtgaatgcagattatgcttttgtcattcatactacaaacccatcgtctggagattcttctgagatatatgctgaagtcgtgaaagggctcggagagactctcgtgggagcctatcctggtcgtgctatgagctttgtttgcaaaaaagatgaccttgactctcccaaggttagttcttggaaattgtcttatggtaggctaatatcatgcaatccgcttcagttgggaagttgatgaatttattatattgtgtgctggtctttctctgccccgcctgcgggtaatttatcacttatcaaaaattttcttacttataaagtagactgcatatgaacatactttatacataggtaaactggtaaaaacatgtaaattaatcggggaaattttcatggtcagtaggtcccccaaccagattgcaaatttgctactaaggatatggtttacctggtttgccagatctaatctgttgcccatttgtagttacttggttacccgagcaagccaattggtctcttcataaggcgatcgatcatctttcgttctgactccaacggcgaggatctggaaggttatgccggagcaggattatatgataggttagggaaatcccattcttgaatgtatgttaaggtgcttattggtttggaatgacagataaattgtctgtttcttcagtgtaccgatggatgaggaggatgaagtcgtacttgattacacaactgaccctcttatagtagatcgtggattccgaaattcaatactctcaagcatcgcacgggctggccatgccattgaagagctatatggttctcctcaggacgtcgagggtgtagtgaaggatggaaaaatctatgtagtccagacaagaccacagatgtag

SEQ ID NO: 9 - DNA, 11693 bp, Zea mays
  gene (1)..(11693): ZmGWD gene
atgtccggattcagtgccgcggccaacgcagcggcggctgagcggtgcgcgctcgcgttccgcgcacggcccgcggcctcctcgccagcgaagcggcagcagcagccgcagccagcgtccctccgacgcagcgggggccagcgccgccccacgacgctctccgcctctagccgcggccccgtcgtgccgcgcgccgtcgccacgtccgcggaccgcgcgtcccccgacgtaagcacctcatgcctgctctatctttcgccgctgggccatcatcagctgatgttctcccactgtttggcaatttgcctgcttcattttcatgtctttccgttgctcttgtcgcagcttatcggaaagttcacgctggattccaactccgagctccaggtgcgaccgctggataccaggttcattcacccatctgctacgattttatctctataacactattggtgcattgtgtgggaacaggtcgcagtgaacccagcgccgcagggtttggtgtcagagattagcctggaggtgaccaacacaagcggttccctgattttgcattggggagcccttcgcccggacaagaggtgtgaggcactgcttctcttgccgcttttgatgataaaacatgtctcaaacatgctcgtatgccatttgctgccgtcgaagcttctcttcccgcttttgcactcagtcacacatgctcttatgccatttgctgcacttccttttagattgaatttgatgtacttgagctacttggctgcagagattggatcctcccgtccagaaaacctgatggaacgacagtgtacaagaacagggctctcaggacaccttttgtaaaggtcagtcgtcttgcatcaaggatctttgtgccaccacggaacagtagttactaatgtccataactgtgcagtcaggtgataactccactctaaggattgagatagatgatcctggggtgcacgccattgagttcctcatctttgacgagacacagaacaaatggtaatgctgctgtttggattactttgcagcactgtttgtttatttgaatgaacaagatatcaaccatctgaactctactttggacaggtttaaaaacaatggccagaattttcaggttcagttccagtcgagccgccatcagggtactggtgcatctggtgcctcctcttctgctacttctaccttggtgccagaggatcttgtgcagatccaagcttaccttcggtgggaaagaaggggaaagcagtcatacacaccagagcaagaaaaggcaagcttttagtactaaacattccatcgtccatcttaatggaagttgatgcactaagttattagtaaactaaaagtaggtagcggttgcatttttctccaggaggagtatgaagctgcacgagctgagttaatagaggaagtaaacagaggtgtttctttagagaagcttcgagctaaattgacaaaagcacctgaagcacctgagtcggatgaaagtaaatcttctgcatctcgaatgcccatcggtaaacttccagaggatcttgtacaggtgcaggcttatataaggtgggagcaagcgggcaagccaaactatcctcctgagaagcaactggtaatacattgattcaacagcgtaaaatagcttgttgatttgatgctttgtggaggttcttatttcacaatttgccaggtagaatttgaggaagcaaggaaggaactgcaggctgaggtggacaagggaatctctattgatcagttgaggcagaaaattttgaaaggaaacattgagagtaaagtttccaagcagctgaagaacaagaagtacttctctgtagaaaggattcagcgcaaaaagagagatatcacacaacttctcagtaaacataagcatacacttgtggaagataaagtagaggttgtaccaaaacaaccaactgttcttgatctcttcaccaagtctttacatgagaaggatggctgtgaagttctaagcagaaagctcttcaagttcggcgataaagagatactggttaggatccttgacagatatcctttgcatttcccgcccttgcttccaccaggctaatcaagcttctctcttcttaaggcaatttctaccaaggttcaaaataaaacagaagttcacttggcaacaaaccataccgacccacttattcttcactggtctttggcaaaaaatgctggagaatggaaggtaaaactccaatttttttgcatttgttaaagctgcaagcagctgtattaaacattgttttcagtgccaatgtggtgttatttaactgtgcaggcaccttctccaaatatattgccatctggttccacattgctggacaaggcgtgtgaaactgaatttactaaatctgaattggatggtttgcattaccaggtggaactaacaccgtcaacttgttataatgccctctttatattagccatcttgccatctcaaggttcttaatgtgcaggttgttgagatagagcttgatgatggaggatacaaaggaatgccatttgttcttcggtctggtgaaacatggataaaaaataatggttctgattttttcctagatttcagcacccatgatgtcagaaatattaaggcaattgtctctgcccacttcaccttgcaaacttcatactgtttcttctgctttgactgttttacagtatcttacttatacacttgatcttagccaaaaggccgagaaaggtatacagtatcttacttataaaactctccaatttgttcttagttaaagggcaatggtgatgctggtaaaggtactgctaaggcattgctggagagaatagcagatctggaggaagatgcccagcgatctcttatgcacaggtcaggccctaaaatatcgataataatatgactaccatttacatggaatgttctcctaaactactttcttcaacagattcaatattgcagcagatctagctgaccaagccagagatgctggacttttgggtattgttgggctttttgtttggattagattcatggctaccaggcaactaacatggaataagaactataatgtgaagccacggtatatacctttctgtattatttacttcagtaaccttttactctctgtttaaaaagaatcagaaattgtcctttttcttttgccaagtgaacctaatttgattgttggtcatcataaatgacaaaacagaatacaatttagtagttatagaatattgtatgggtacaaacaaaaacgtaactcatttgcatattgtacgacatctcataatgttcaataaccatgtgcagtgagataagcaaagcacaggataggtttacagatgatcttgagaatatgtacaaagcttatccacagtacagagagatattaagaatgataatggctgctgttggtcgcggaggtgaaggtgatgttggtcaacgcattcgtgatgagatattagtaatacaggtaaaaataatggtccttggtgaatatacagttatttttgttcgttgctttgatgaattaagcagttggtagtgctcatccaaaacatagacatgtcaacaataaaatgcttggtgtgttacagagaaataatgactgcaaaggtggaatgatggaagaatggcaccagaaattgcacaacaatacaagcccagatgatgtagtgatatgccaggtattggatgtttagaattcctaatattgcaaacatctaagctttgaggttttgatggtttcgtctctccttgggcaggccttaattgattatatcaagagtgactttgatataagcgtttactgggacaccttgaacaaaaatggcataaccaaagagcgtctcttgagctatgatcgtgctattcattcagaaccaaatttcagaagtgaacagaaggcgggtttactccgtgacctgggaaattacatgagaagcctaaaggtatgtgacacagctagtatggataataaagtgttggggaaaagttgtgccctatgtttgaaatggaatatagtttttcgaagacaacatatgaaaacacatattgtgctatactatcaattcagaaaaaaatgagttactgtaaaaaacatacagacaaattgtatactagtgtgcctttttctgctaatggtatatgttgttctgtccattatatgcttccaatagtaatgtttctagctttgacaatgtgcaaaagccctggtatgcccattactgtgcacgtgagcaccgtacccctttgagcaccggatacaaaccctatgcgattgaatgagtatgcctcgttggatacgtatatgacatggatactgtttggatacgtatccctggagtatctgtaaaaaaaatcaacaacaattcagattctctttgcgtttgtttgatatgtcgttccgatatagctcagcccaccaatagctgttccctgattccccatgcatgctgcctctcttctcccgtaaccctagtaccctgcacagccgccacaacacgctcacacgcaagagctcatgcacggccaagcaacggtggtgacgaagtccaccgctccacagcagttcctgtggaggtaaggccgaagagatccttatggatgtgcgacatcgtgtcatgctgctgcataaggtggggctaaggttgtgctcatgctagatgactaaggcacgaggatggtggcgtagtgagccctagctctgataccatgttagagaggaatgaaatgataacttgtctattgcgtagggcacaaagggcaaatgtacatagggtaagtttacagagagaaccctaaattctagagaaaatataatacaagaaaggaactacatatacactaacaatgaccatgatgcgggccctgctcagttcctatcacaagcatcagccatggcacatggatagttgcttgggcgaccatgacaaggccaagagcagcctctccgctcattgatccgtgctgcaacgctgttgctccaagcgaagggaggtaagaccaccagagtgttgtgcgttgcttgctagtcatggtcagcactcaatcagtgagctttccccttcgtctaatgcttttttgtttatgcttgcctgttggaacattggctggaatgaaatgaaaatagggagaggatgagcaaaacaacacaattacaagaatgcaagacttggctgccactgcttgtagtttttaactatgctttattatgtatttatatttattagaaatacttaaacatatccacgtattgtgttttttttaacgaaaatgtcatatccacatatctgtatccgtcaataccaccatatcggtgttgcacaggttgcaacctgcccttgacatcctgttgggtcaaagggtggttggtatatacccttgacttcaagtttggttaagggtggtgtgtttcttttgttgggctgctttttcctctctataatatacaacgacgcacaattctcctgcgtgtttgagaaaaaaatattcgctgtttgcctagtggagtgtctagatcgtctatatgacatttataccttaattgggacccaagtctggagtctaggcagtatggatgtgcaattagagcttcgatgctgattagttaagattaatcactagccgtgaagtggtcgtttgtctagtgtgtagtgtcacgttataccttttgtgtgacaaaaaagaagatatgcatttactcatattttctgtgattgaatattcttttccagacatactgttttattaatgttattctttttctcattctgctaggctgtgcattctggtgctgatcttgaatctgctatagcaagttgtatgggatacaaatcagaggtatcatcctcatccctatttgttctgctacaatgctttatgctcacgtctattgaactaaccttttggatacagggtgaaggtttcatggttggtgttcagatcaatccagtgaagggtttaccatctggatttccggtaaaaatccctaaaacttcttttctcaaaacatgtactccctccgttcttttttatttgtcgccgattagttcaaatatgaactagcgggcgacaaatattcgagaacggaggtagtactttcttagtttcttacatttgtgacatttactgcccatataggagttgcttgaatttgtgcttgaacatgttgaggataaatcagcggaaccacttcttgaggtcagtgataatagatccaagttcctgaattctattaaaacaaagagctgatgctaggattcattatctcaattcaaacaactagatctccataactgactggattatttaatccactcatttttgtggttactttgtgaatcagttattgataaatgataacgaattgtcaacttataggggctattggaagctcgagttgaactgcgccctttgcttcttgattcgcgtgaacgcatgaaagatcttatatttttggacattgctcttgattctaccttcaggacagcaattgaaaggtcatatgaggagctgaatgatgcagccccagaggttggtcacacaaatattgctatagcagacattattaaatgcaccttttccgtatcacatgttgcttttatcttatccgaatgcatttatctcatgacaccgtttttctcaatccagaaaataatgtacttcatcagtcttgtccttgaaaatcttgcgctttcaattgacgacaatgaagacatcctgtattgtttaaaggtacactttgactctttattatccagaaatagaaagacttgaagtttacattattttatgaatttttgataataaaattggtatgcatgtcctaatctagtttatgtagatcagacagcctctgaaaattccacttttcttgcttctttaccatgtgcctttcttaaacgttctctccaaaatatctagaaaagtattcatattttgatatacttcaaataagtatcatgccaaaatttgctaacgaaaacatgcagacagagaactattaagtaacaccatactgctgttgaaattcttattttgatcactgcaagaggggaaatgttatttgcctcatcatggtcattaacaattagtgtatgaactctgtcctatatatttcgatattatatttagtgacaactattaattttgtagtattatgaatttacattgcatatgttgttattcatgcacattaaacacatggatggtcaaaatttcaactgtttgaatcacatggatccagaagtgacacttgttttaggatggcatttgtgctatctggaaataattgtttgtttgaacttatttgtcattctattgtgatgcttaacaatggcgatgttgtctaaatgttttttcctgaagggatggaaccaagccttggaaatggctaagcaaaaagacgaccaatgggcgctctatgctaaagcatttcttgacagaaacagacttgcccttgcgagcaagggagaacaataccataatatgatgcagccctctgctgagtatcttggctcgttactcagcatagaccaatgggcagtgagtacttcatagaaatcaaacctaatgttccatttgttcatcaagaaattaataataaatataattttcaggtcaatatcttcacagaagaaattatacgcggtggatcagctgctactctgtctgctcttctgaaccgatttgatcctgttttaaggaatgttgctcacctcggaaggtaaaaatgtaaaatctatgactgctgttgaacttcttttactttgtatccccagtatatgaacacataattctaaggactactttgggaactcaaatccccttcgggattgaaggggattggagaggaagttagtttattttcacctcaatcctctcctatcccgaaggggatttgaggttcccaaagtagccctaaaagtgatactagtgaccctctccacaattttatgcgaaccacagaaattaataatatattctattactctgcacctgacatctggctcctgctatcagttggcaggttataagcccggttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtctcatgtgtcagtccgagcaaggaatagcaaggtttatcttcacagctatgttgcaagatttcttgaattttttctcttgtattgatgttgacatactagctttttcctaatgaaggtactgtttgcgacctgttttgaccacaccactctatctgaacttgaaggatatgatcagaaactgttttccttcaagcctacttctgcagatataacctataggtacttgaggctatttgaacgtcatgtctaatgaagctaggttataaaggctaataactaattcttttttgaatatttccttccatcagcttagttcattcatttggtaacttagatccatatatatagatattttgagagtcaaatttgggttgtttttcctaaaatgtgcagtctatcattgcattaacaaaacaaattgaaaaggcaccacacaaacacaaccgccacgaaaacaacacttgcaattgcaacacctacactaaccaggtccagggatttcaaagtgcgacactgattaaaaataaagaaaacaactaaaacaatgtattattatcaaaggcataaagaatatgtctatagggttaatataatcttctgtgtagacgacaagtgtctataaacctggctaattatcaccgtgtgtttgataatttttttttcttactttacacaatttatggtcgagctacacttgatggcacatcatcaacttggacaatatctggctgggtgatcccatgttaccaacatttcacagcccatctggaataatctgttagatgcccacagctcatatattgcattcaacagggagatcacagagagtgaacttcagcaatcaagttctccaaatgcagaagttggccatgcagtaccatctatttcattggccaagaagaaatttcttggaaaatatgcaatatcagccgaagaattctctgaggaaatggtatgtaatacaaacttttgcatcaaaagaaaaacttgatgaaaccagctgttactatgctggtattcttttcttttggcctcgtgcttacactcacatttctattttcaggttggggccaagtctcggaatatagcatacctcaaaggaaaagtaccttcatgggtcggtgtcccaacgtcagttgcgataccatttggcacttttgagaaggttttgtcagatgggcttaataaggtcagttggtggttctttattgacattatatattttaataatagtgctatacatttgttggagaagtctgtttcttgtacatgtttgaagtatacaattgggaagatatcaatatgcactttaatgttcaccaagttctaaggggtcattttggtattcagaacaccaatgtatttttctgagcctgctctgtaagtagcatcttcagtagtatgtatttcatatctttacagtctcattctaccatgaactaaatttgctaaatgacatatacgctcaaataagttatgattttcctaatattacctttgatggtaaatgaccctgccatgctcattggaaggtgtctttagaaaggagacagaattggccatatcaaagcaaatgaaatgataacaagcctctttttagggatttgttgtgcactttgaactagtgtctccctcttttttttcttttggatccattatccccctgtctttttcttgtttatttcttttcctctttctatggtttccttataaatgaaaaatatcagtcggggaccctctgctgtttcatcaaaaccgatctgccttgtatttgattgttcttttatggcaggaagtagcacagagcatagagaagcttaagatcagacttgcccaagaagattttagtgctctaggtgaaataagaaaagtcgtccttaatcttactgctcctatgcaattggtgagatgtctctatatgtttatatttgttgcaattaagacatagttatgacattaatctttttattgtttcatgtatgccttattttgtgtctcaggttaatgagctgaaggagaggatgctaggctctggaatgccctggcctggtgatgaaggagacaagcgttgggagcaagcatggatggctattaaaaaggtaccctgatctaaaattaatactagcatccataagattcggcacatccttgtgggtcatctgcttagaaacaccaatggctttaactttaagggcatgttttgtgcagtggtgagaactgtctcactaagtcaccaggttgtaagttcaaaggagtgtttgtatctgcgggaaagggcttgcctcggtttgtcccttccaatccatagacccctttcatgtgggagcctttggcactgggtctgccctattttttttgtcttcattcatgggtcatttgatctcatatattgtagatagatctattacaaataagaaacatgcttggaaactgaatgtaagaaaaaaattccaagtatgataattgaatatctccatttcctttttaggtttgggcatcaaaatggaacgaaagagcatattttagcacacgcaaggtgaaacttgatcatgagtacctttcgatggctgttctcgtgcaagaagttgtgaatgcagattatgcttttgtcattcataccacaaacccatcgtctggagattcttctgagatatatgctgaagtggtgaaagggcttggcgagaccctcgtgggagcctatcctggtcgtgctatgagctttgtttgcaaaaaagatgaccttgactctcccaaggtttgttcttagaatattgtcttatggtaggctaatattatgcaatccgcttcagttggaaagttgatgaatttattatattgggtgctgcgttgttcttaaaaatttcaacccaaacacaaagtatgttataaggaatcctgcccccccgccctctaatttaacttaatttttttcttacttataaagtagactgcatatgaacatactggtaaataaatgtagattaattgaggaaaaaataatggtcagtaggtcccccaaccagattgcaaaattgcaactaatgatatggtttaccagatctaatctttaacccatctgtagttacttggttacccaagcaagccaattggtctcttcataaggcaatcaatcatcttccgttccgactccaacggtgaggacctggaaggttatgctggagcaggattatatgataggttagggaaatccctttcttgaatatatatgttaaggttcttattggtttggaatgacagataaattgtttgtttcctcagtgtaccgatggatgaggaggatgaggttgtacttgattatacaactgaccctcttatagtagaccgtggattccgaagctcaatcctctcaagcatagcacgggctggccatgccatcgaggagctatatggttctcctcaggacgtcgagggagtagtgaaggatggaaaaatctatgtagtccagacaagaccacagatgtag

SEQ ID NO: 10 - DNA, 3087 bp, Sorghum bicolor
  5'UTR (1)..(3087): SbGWD gene 5'UTR and promoter
ttatttgtctcggccacacttaagaaatagtgaacgctattaatgaactcttcggagcgccgatcggcattatacatccaattacgtgttaccatctgcattaaatataacatatatattatgaaaaccatgcacacatatagtttctcatcttattgcacaacatgtctaagatacatagttgattaattcaggaaagcttggctacaacaaatacaatcgcaactagcactaaaaaaaccaaaactaaaatgcacttaagcaacataattagttcgcgtccgatcccaactataatagatagatcattcgcttgatcaacatcattgaactcctttcgtcggctcactgcctcaccaccttcagcctcaaccacctgtgcaaaagatttcttaatgtgttcaatatattcttcctcccagtaccaacctgtacatccgccggtaccgttccactgaaattaaaagagagaatcaaaagtttaattaatatcatttaaaaaatatgcacatatatataagcaaatgtttggaaataactcacattacgattcagacacttgtagaatatacgacccttgtttactccctctttcgacactttgtactccatcacaatcttctgcccacacttgccacaagtaatgagagggagttccggccgctatcgcttttgaacccgttgagagaccgaagacccagtcacggttgccatctactatccatactcattttttaaacaattataaattccacatttactagtaaacatatatgatacaatggacattatgtagtaataaaaataaatcaagtgatcttaacaaaccaattaatttgaactatcctactttctaagatcataaaaatatactataattcattcttgcaaactacattaatactagatcaaccatgaaatatgatatatatatatggatactaattcatgtgaatgattcaaaataacaaagtggatttgagctaaaaataatgggaacatcacaagccaaaaacaacatgaaaaagacaagaaagacaaaagttagtcacctccaaacacgaagaaacgatgacggagtcgaagaagatcaacgatgggcgtcggcagtgttcgcctaaacggccgattaaacggtcattaaacggtaaacggtggcaaactgttttgtttagggggtaaacgggaaattaaacggttgaccgtttaaatggtcaaaaaacggagaaaacggtctaaacggcctacacggaacggttgtaaacggtattaaacgtgccaaacggctgtttaaacagccgtttaggcaatcaccaggtgaatgtagttgaattttatatcaacaatttgtatacttaaatttattatatttataaatatataaaattgatttattacatgcataaatatgtatatttaattcttctaacatgcataaacacatatacataacaaaataaatggtttttagttgcataaatatgtataaatgatagaatgattgattttacattaaaaaatatgcacatttttgtaatattgtgtaaaaccgtttagatcgttttaatctgtttaaacaccgtctaaacagtttaaacgctaaaagaagggtgaccgactgtttaccgtttagcgtttaagataacattggacgtcggagatgaaaaacaaatgaagaacaaggaagaagaagctccaaaaacaacaatggtgaatggtactctcgatttcaaatgggtagagaggatccggcctatataaaccggaccattagcaccggttcagggcaaaaaccgatgctaaagggtttgcctcggccccgtggcgctggtcggtgctaaagaggaccctttagcaccggtttgtaatgccccgacagcacctgtcagtagccgttgggcaggaccctttagcaccggggctttgtttagttccgaaaaattttagaaaatagacactgtagcactttcgtttgtatttgacaaatattgtccaatcatgaaagactcaaaagattcgtctcgtcaatttcgaccaatctgtgcaattagtttttattttcgtttatatttaatactccatgcatgcgtctaaagattcgatgtgacggaaaatgtgaaaaattttacaaaattttctgggaagtaaacaagacccggttaatgttagaaaccggtctttaacccggaccgtaaaaagggctgaccattttcggcaatggcttattctactgtggtgaagctaaacttaggtgccaaagcctcggcctgttgatgaatgtgcgacttttgacttttgatgatgattgatatgagaagctctccaatggatttgcatgtgtgtatgctgaaagattggtttgattttgttgccacatgcttgtccgaaactgagataaaattaggggcctcggaaaaatatctgattggtctttccatagatgttgatggtgccacttttttcagtgcgctgaaaatggcagaaattggaagggagaggatgcgaaattggcattaaatttggttctctcttgcttcctcgaagcgagaagataattacgtcgcgtcgcgtcgcgtccacccacgccgctctggctctgtgcgcactcttcgggaacgggacagaggagagagaagcgagcaacgagacgctgcgctgacgcccgcctcgcccgcgcccattcctcctcccactccatccgtcttcctcctccgcagcccccgcttcgcctctcgcctccttcccaatcctcttcttttcttcccttcgctctctcggagccacgcatccatcctgctaagtgctaatataacatatatagcatcggtgagtgcgcgatggcttcatcttgctgattgtgttcgtggcttcttgatactccggccgtgcgtgcgctggcttgatcttggctgcattccattaatttccactcgttcgcttcctcatcgcgataatatctgcttcgtcttttttttttgttccttctggcatgtatgtgtaggaagcgagtgagcaagccgagcaacagcggctgagattcgctgcaacgtcgatatcaaaagtgcccgagcggttgagattcgtgcc

SEQ ID NO: 11 - DNA, 3000 bp, Zea mays
  5'UTR (1)..(3000): ZmGWD gene 5' UTR and promoter
gtacaaaaatgagttatcgtgatatatgtttccgttgcaacgcacgggcactcacctagtatatatatatatatataggttcaagattgcgcaacaacggtaaccataaaaaagtaaagaccaaaaagaataattaaatggtcagaaggagaagaacaaaatgaagctaagctcattggtccacctattgttggccaaaataagaagacaaaatgaatgcccaaaaaactagtcactaacattggagtacccacctaaattaattttattttctttgttaggtaaattacaaggccagtggaagatgatgtgagcttttatagtgaatgcactcaacatttgtttggagatgaagggatgttcaattcaataaacataagtggtaaacatgagcttgaaagtatcacatttagtgacaacgacaaaggcaaggttaaagggcttggaaagattgctatagcctatatccgttcataccctctttataatacaattaagggagaaacaaagttctaaactattataagtgtctctcaactccaaatgacacttagaacgagtacatcattaaccttgtctttcctccatttaaaacaaacaaaaaatgaaaccataaatagggacatgaaaaccatagattgcatgaaacaatctccatcattgtgacctgaactcaaatttgccttgcaaaacacatattagccataacaaccttatgttgtcattaattaccaaagcatttgagggactaaatgcattcatgtaggtttagtgacttaaatgcagtggcaaagctatgagatatgttaggttattccatatatttttcttacgaattatgagtatagaatatattggacccataagtccacaaaatagttaaaatatatttatgcccataataaatctatagtaataaacaaagtacagattgtaacataatggcgttggagcaatacctattcttcatctacattacaagagcacaatggtaaaaaaataaatctttgtttggcttgtcttaagagataaaatcaactcgaagaatttgctcagaaggaaaggttttctagtgatctgcattgtgttctttgtgactctaactgcaaggaggctacattcgttccatctgttgtttgagtgtcctttcagcttggaatgctggcagtatgtcggtattcagtggaatcttgagctagatttctttctaatgttcgaaaatgcgaagagcgcttttgcccgacgcctcttcataaaaattgtggcttttgtgacttggaccatctggaagcaaagaaatgatttcatctttaaaaatatggtcccttcgttttctacatggatgatttgtttcaatgacacgttggagcttcagatgtttggatttagccctacccttaatttttgagtatcctcttctttctctttcttaattttttagtatcctcttctttctctttctcttttttctatccagctcgttcggttcctttgtttcatcttgttatattttatgcaataaataaagctgtgccgcaggtttcctctacatcctttttcttttcaaaaaaacgtcacagactatccaagtaatttcttcacaaaactaccaaaggtagcatgcagtggcataggcaaataaatttcttctaaattgtataaaacacaatagtggcttgctctaaatttcatcaatcatcaatactgtgattcgttttagatcttgtgccatcaacgcggccatatcggccagtgttgaggggtcaaaccggggatcgatatcctaggctgcagttgattgtgggctaactaggcaatgagctgtaagtatatgctacgtaacgtacatatttttgtcgttcttgccaaaatcaagcctcagcttaaattcgtttctagcagtacttttgattgatataataagttctaacgattttgcgtatgtgtatgttgaagatttgtttgattttgttgccacatgcttgtccgaaactagttgcagcacctgaaatctgatgcaaattcaagtgccatataaatgacggataaaattaaggacaccaggaaatatatgattggctcaaaaactgaatgtaacgctgtcagttatcgcttctcagagcaaagcaagtacaataatatgctgtaaaataactaattgttgaggtaaaagagagataaaaagaaagagaagagagagataaagctgtaaaaactaatactacatattagaaaaaatattatatacacccaggatgtaaaaccactactttgcagcttttcatatccacaccaatagaaaaaaaattaggcttgctagtaaaatctcacatgttcatgttgctacgtctttccactgatggtggcatggtgctacttttttttttcagtgcgctgaaaatgatagaagcaggaagggagaggatgcgaaattggcattgtaattcggtctcttgctacctccaagcgagaagataattacaggtcgcgtctcgtagcgtccacccacgccgacgccggactgtgcgcattcttcgggaacgggacagaggagagaggcgagcgagcaacgagacgctgcgctgaccgcccgccccgcccgcgcccattcctcctcccactccatcctcctcctccgcagcccgcgcttcgccgctcgcgcctccttcccatcctcttcttttcaccgccacccctcttcgctctttcggagccaccgtgagtgcgccgcggcttcatcttgctgatcgtgtccgtggcttcttgatactccgtgactgtctccgtccgtgcgtgcgctggcttgatcctggcggttcttgttcttgcctgcattccactcgttcgcttcctcgcgataatatctgcttcgtcttttttttttccttctggtttcttctggtatgtgtaggaagcgagtgagcaagccgaccaacagcggctgagattcgctgcaacgtcggtatcaaaaggtgtccgagcggttgagattcgcgtgcc

SEQ ID NO: 12 - DNA, 1388 bp, Sorghum bicolor
  3'UTR (1)..(1388): SbGWD gene 3' UTR
catgtatgtattagctagctcaataagcactgttgtacgcttgtatggttgggacatatgggtgttatggcatgtatagtttatgcctagatgtacaacacgtgtaaactcttatatatgtatatatgctgaaacaagcattggtcctgcaatttcattgtgaccagtctttgaaaatgaacatgccgacttattgggcaaaaaaaagtttacattcatacttgtgcaaatattttctaaagatgttgaaaagtgtaaccagcttctcatgagtataccagagttataccagttagagcagtgtgctcggggatctcttgctagtccgtgttttttttttattttgaaaaggaagtatggaggggagagattccccgcctagatttcattaaaatcgggagaaaagttcaggatacaaagcataaattaggagctaatcgaagccctgattagaagtacaagaatgtaaaccaaaacagcacccccagcataagggccagattgtggcatatgtttcaccagtacaacaaatagagaaaaagaaaactacaacaccaagtcacgggaggtggatgatgatgcgacataatcatcatcagccaagcaacaagaggtgacgccataggagcttggcagggctttcaacagtggggttgaaatgggccgactatagagaaacggtagcaagagattttgtagcgatgccttgaaggagatgattgtcgctagcgactcacctgaggcgagctttcacctagaacctttatcagtactcctactgacccatccgtgacaaatggaggtgcacgcaccgacgagcaaccgtaccttgccacacctcgtggagttgtttccggactcgcccacgatgatgggaggcatgcaccgcatggacagaggagggggtgttggtcaccaccccaccgtgtggagccgttgtgagactcaccctcgcctgcaatgatgggaggtgcgcaccgacaattgtccatgcttggataggtgttggtgctagccacctccacacctcgcgaagttgttctcagacttgcccgtgttggtgggcggcacacacccacaattatccgcgcttggacgatggtggtgccgaccacctccatacctcacggagccattcttggtctcacccgcgtcggtgggaggtgtgcaccggcaatcgtttgaacgggggtggcggtgttggccgcctccacaccttgtggaaccgttctcggactcgcccatgatggtaggaggcgggcactggcagtcgtccgtgcctagacgaggtggtgctagccgcctccacacctcgtggagctgttcgctgacttgcccgtgtcaatgggaggtgcgcatcgacagttatctacgtctggactggaggt

SEQ ID NO: 13 - DNA, 2000 bp, Zea mays
  3'UTR (1)..(2000): ZmGWD gene 3' UTR
tatgtatgcatctattagacagctcaataagcactgttgtacgcttgtatggttgggacatatgggcgttatggcatgtatagttgtatgcctagatgtacaacacgtgtactcgtatatatatatataaatgctgaaacaagcattggtcctgtactgtagtttctacatttcattgtcaccaataattaagtgtactcctatggctgggagtctatgaaaatggacgtgttgacttattgggtaataaataatttatatatatacttgtgcaagaattttctcaatatgttgcaaagtgtaaccagcttctcaggagttatatcggttggagcagtgtgctcgggtacagcttcttatttcaatgtctccagtgggcgtcttacctctatgtttgtgtttttttttaagtgcagaaatagagaaagttcttgcaaatatctactctatgaaaaggacagctatttggaaatatgtgaacagaactatccccagttgctgggaaaaaccaagaagaaagttcctgcaaatatctactctatgaaaaggacagctatttggaaatatctgaacagaactctcccaagttgctgaacaaaaccaaagacagaaggaaccaccacaatccatacagaaatggtagggttcttcggcgcctctgctgcatctgatcactgtcgtttgctgacaacaaatggatcagttcaccatgaactgattagacgacaccatggcagaccaagaagtgcgatcaggtgctgcagcagcacggcaaggggaaggaccagggactattactaccaggtgctgggcatcgcaattcaatccacacctcagcagatcaaggaggcttacaggaaactccagaagcaacaccatccagacatcgccggctacaaggtgcacccatgcctaccatttgctctcctattcttccgctcatccctcctccttccattcatagttggggtgtgcgtgcccaggaaaacagcagctgctggttttatttgggcagcttctaatatcaaatctgttcgattttctgaagctaaaaaacagaatgttttgggatctgaatgtgcagggccacgactacacgctgctgctgaacgaggcgtacaaggttctgatgcgggatgtttccagttccaggcacgccgatggaaggggcaggagtagggtggggtcaggagccggttacaccggggacggatacagttcttgggaagggcccgtgagaagccaagctctcttcgtggacgagaacaagtgcataggatgccgggagtgcgtgcaccatgccgctaggacgttcgccatggacgacgttctcggcagcgcgcacgtggaggtccagttcggcgacctggagcagcagattcaggtcgttttcgtttcctgacccgactctacagcgtagaaaaaaaaatcacctagttctctgctgattagttgaactgctgtatgttgtttgtgcaagggcagctggctgtggagtcctgccccgtggactgcatccactgggtcgagagccacgacctgcccgtgctggagttcctgtcccggccgcagccgaaggaaggccacggcgtattcggcggcgggtgggagcgccccgggaacgtgtttgcggcggcgaagaacttcgccaggagactggagagggagaagcagcgggaggagctggaacgggatcagccctccgggggcctcgacggtaaagtgaacgaaaatatttttctctccactccacttgttcgtgcaaatgagcttcagaaactttggttgcaggggacgcaggccgcgaggcggagacggaggcgcaggccgaggcgaggcgcagcgcgtgggaggagctcaggtggaagcccctgcttgatgcttggaatgggctgataggtggtcgttgacgctgcaggaggttgaagagaagctcagcgctggaagctgaacccgtaacatctgcagctgcagaaatagtggatgtgccaaggacaaaa

SEQ ID NO: 14 - protein, 1212 aa, Sorghum bicolor
  MISC_FEATURE (1)..(1212): SbPWD protein
MASLRPFDPSLAARPGPPPPARPAARRPVPAPPLAAPFASALIFPVRPRIPGRTRGTGVAASTKHITRTKEEKQTDPSKQDIVRLHVCLDHQVMFGEHVGIIGSAKELGSWKSPVEMDWTPNGWVCQLDLPGETLLEFKFVVFLNRGKDKIWEDGDNRVVNLPKNGSFDMACHWNKTKEPLNLLGTSEIKLSGDTEKEKDEDAKLSRNIALEEMGNISNAGDGDLTPKLESSTLGGLWQGSDTVFMRSNEHRNNESDRKWDMTGLDAVSLKLVEGDKASRNWWRKLELVRGLVSEYVHDQSHLEALTYSAIYLKWIYTGQIPCFEDGGHHRPNKHAEISRQIFREIERIYYGENTSAQDLLVIRKIHPCLPSFKSEFTASVPLTRIRDIAHRNDIPHDLKQEIKHTIQNKLHRNAGPEDLIATEAMLARITKTPGEYSEAFVEQFKTFYSELKDFFNAGSLLEQVQSIEQSLDESGLEALSSFLKTKKNLDQLEDAKDLDENGGVQVLLKTLLSLSYLRSILMKGLESGLRNDAPDSAIAMRQKWRLCEIGLEDYSFVLLSRYINALEALGGSASLAEGLPTNTSLWDDALDALVIGINQVSFSGWKPNECTAIVNELLSWKQKGLSEFEGSEDGKYIWALRLKATLDRSRRLTEEYSEALLSIFPEKVKVLGKALGIPENSVRTYTEAEIRAGVIFQVSKLCTVLLKATRAVLGSSVWDVLVPGVAHGALIQVERIAPGSLPSSIKEPVVLVVNKADGDEEVKAAGDNIVGVILLQELPHLSHLGVRARQEKVVFVTCEDDDTIKNTRLLEGKYVRLGASSNNVDLSVVSNKDECAAMSSELSSGGNLFAQQFSLPLTTDKKLELSEQRSYTSGANIMSGVLELSEASIESSGAKAAACGTLSVLSSVSNKVYNDQGTPAAFRVPAGAVIPFGSMEDAFKKSGSLKSYTNLLERIETAQIENGELDSLSAELQATVSLLSPSEEIIESLKRIFDQNVRLIVRSTANVEDLAGMSAAGLYESIPNVSLSDPSSFCAAVGQVWASLYTRRAILSRRAAGVPQRDAKMAVLVQEMLQPDLSFVLHTVSPVDHDPKLVEAEVAPGLGETLASGTRGTPWRLSCHKFDGKVTTLAFANFSEEMVVLNSGPTDGEVTRRTVDYSKKPLSVDATFRGQFGQRLAAIGQYLEQKFGSAQDVEGCLVGQDIFIVQSRPQP

SEQ ID NO: 15 - protein, 752 aa, Zea mays
  MISC_FEATURE (1)..(752): ZmPWD protein
LLEQLESIEQSLNESGLEALSSFLKTKKNLDQLEDAKDLDENGGVHVLLKTLLSLSYLRSILMKGLESGLRNDAPDSAIAMRQKWRLCEIGLEDYSFVLLSRYINALEALGGSASLAEGLPTNTSLWDDALDALIIGINQVCFSGWKPNECSAIVNELLSWKQKGLSEFEGNEDGKYIWALRLKATLDRTGRLTEEYSEALLSIFPEKVKVLGKALGIPENSVRTYTEAEIRASVIFQVSKLCTVLLKATRAVLGSSVWDVLVPGVAHGALIQVERIAPGSLPSSMKEPVVLVVNKADGDEEVKAAGDNIVGVVLLQELPHLSHLGVRARQEKVVFVTCEDDDTIKNMRLLEGKHVRLGASSNNVDLSVVSNKDDCAAMSSEPSAGGDLFAQQFSLLTTDKKLELSEQKSYTSVANGMSGVLELSEASIESSGAKAAACGTLSVLSSMSNKVYNDQGTPAAFRVPAGAVIPFGSMEDALKKSGSLKSYTNLLERIETAQIENGELDSLSSKLQATVSLLSPSEEIIESLKKTFDQNVRLIVRSTANVEDLAGMSAAGLYESIPNVSLSDPRSFGAAVGQVWASLYTRRAILSRRAAGVPQRDAKMAVLVQEMLQPDLSFVLHTISPVDHDPKLVEAEVAPGLGETLASGTRGTPWRLSCHKLDGKVTTLAFANFSEELMVLNSGPTDGEMSRRTVDYSKKPLSVDATFREQFGQRLAAIGQYLEQKFGSAQDVEGCLVGPDIFIVQSRPQPQ

SEQ ID NO: 16 - protein, 1196 aa, Arabidopsis thaliana
  MISC_FEATURE (1)..(1196): AtPWD protein
MESIGSHCCSSPFTFITRNSSSSLPRLVNITHRVNLSHQSHRLRNSNSRLTRTATSSSTIEEQRKKKDGSGTKVRLNVRLDHQVNFGDHVAMFGSAKEIGSWKKKSPLNWSENGWVCELELDGGQVLECKFVIVKNDGSLSWESGDNRVLKVPNSGNFSVVCHWDATRETLDLPQEVGNDDDVGDGGHERDNHDVGDDRVVGSENGAQLQKSTLGGQWQGKDASFMRSNDHGNREVGRNWDTSGLEGTALKMVEGDRNSKNWWRKLEMVREVIVGSVEREERLKALIYSAIYLKWINTGQIPCFEDGGHHRPNRHAEISRLIFRELEHICSKKDATPEEVLVARKIHPCLPSFKAEFTAAVPLTRIRDIAHRNDIPHDLKQEIKHTIQNKLHRNAGPEDLIATEAMLQRITETPGKYSGDFVEQFKIFHNELKDFFNAGSLTEQLDSMKISMDDRGLSALNLFFECKKRLDTSGESSNVLELIKTMHSLASLRETIIKELNSGLRNDAPDTAIAMRQKWRLCEIGLEDYFFVLLSRFLNALETMGGADQLAKDVGSRNVASWNDPLDALVLGVHQVGLSGWKQEECLAIGNELLAWRERDLLEKEGEEDGKTIWAMRLKATLDRARRLTAEYSDLLLQIFPPNVEILGKALGIPENSVKTYTEAEIRAGIIFQISKLCTVLLKAVRNSLGSEGWDVVVPGSTSGTLVQVESIVPGSLPATSGGPIILLVNKADGDEEVSAANGNIAGVMLLQELPHLSHLGVRARQEKIVFVTCDDDDKVADIRRLVGKFVRLEASPSHVNLILSTEGRSRTSKSSATKKTDKNSLSKKKTDKKSLSIDDEESKPGSSSSNSLLYSSKDIPSGGIIALADADVPTSGSKSAACGLLASLAEASSKVHSEHGVPASFKVPTGVVIPFGSMELALKQNNSEEKFASLLEKLETARPEGGELDDICDQIHEVMKTLQVPKETINSISKAFLKDARLIVRSSANVEDLAGMSAAGLYESIPNVSPSDPLVFSDSVCQVWASLYTRRAVLSRRAAGVSQREASMAVLVQEMLSPDLSFVLHTVSPADPDSNLVEAEIAPGLGETLASGTRGTPWRLASGKLDGIVQTLAFANFSEELLVSGTGPADGKYVRLTVDYSKKRLTVDSVFRQQLGQRLGSVGFFLERNFGCAQDVEGCLVGEDVYIVQSRPQPL

SEQ ID NO: 17 - DNA, 3642 bp, Sorghum bicolor
  misc_feature (1)..(3642): SbPWD coding sequence
atggcgtccctgcgaccgttcgacccctcgctcgcggcccgccccgggcctcctccgccagcgaggccggccgcacgccgccccgtgcctgcgccaccgctcgctgccccgtttgcgtccgcgctcatcttccccgtgcgcccgcgaatcccagggaggacgagagggaccggagtcgcggcatcaacaaagcatatcaccagaacaaaggaggaaaaacaaacagatccttcaaagcaggatatagtgcgtcttcatgtttgtctagatcaccaggttatgtttggtgagcatgttggcattattggttcggcaaaagagcttggctcatggaagagtccggttgagatggattggacaccaaatggttgggtctgccagcttgatctccctggagaaacacttctggagttcaagttcgtggtgtttttgaatagaggcaaggacaaaatatgggaggatggtgacaaccgtgtagttaatttgccaaaaaatggttcatttgatatggcatgccactggaataagacaaaagagcctttaaatcttttaggaacatcagagattaagttgtctggagatactgagaaggagaaagatgaagatgctaaactatctcgaaatattgctctagaagagatgggaaatatttctaatgctggggatggcgatctaacaccaaaactcgagtcgagcacacttggtggcctatggcaaggtagtgatacagttttcatgcggtcaaatgagcatcgcaataatgagagtgataggaagtgggacatgactgggcttgatgcagtatcactgaaattggtggagggtgataaagcatcaagaaactggtggcggaagttggagcttgtccgtgggctcgtatctgaatatgttcatgatcagagtcacctggaggctcttacatattctgcaatatatctaaagtggatatatactggtcaaataccatgctttgaggatggtggtcaccatcgacccaataaacatgctgagatatccaggcaaatttttcgtgaaattgaaaggatatactatggggaaaacacatcagctcaggatttgcttgtgatacgcaagattcatccttgtctaccttcatttaaatcagaatttactgcctctgttcctctaacacgaattcgtgatattgctcatcgtaatgacataccacatgatctcaagcaagaaatcaagcatactatacaaaacaagcttcaccggaatgccggccctgaggatcttattgctactgaagccatgcttgctaggattactaagactcctggagagtacagtgaagcttttgttgaacaattcaagacgttttatagtgaattaaaagatttcttcaatgctggcagcctactggagcaagtgcaatccatcgagcaatctttggatgagtctggcttagaagctctctcatcctttctgaaaaccaaaaagaatttagaccaactggaagatgcaaaagatttggatgaaaatggtggcgttcaagttttgttgaagaccttgctgtcgttatcttatctaagatcaattctaatgaagggtctggaaagtggccttagaaatgatgctccagatagtgctattgcaatgcgacaaaagtggcgtctttgtgagatcgggcttgaagattattcgtttgtattgttaagtagatacatcaatgctcttgaagctttgggtggatcagcttcacttgcagagggtcttcctacaaatacaagtctatgggatgatgcccttgatgcccttgtcattggcataaatcaagttagcttttcaggatggaaaccaaatgagtgtactgcaatagtgaatgagcttctttcttggaagcagaaaggtctatctgaatttgaaggcagtgaggatggaaagtatatttgggcactgagactcaaagccactcttgatagatcacgaagactaacagaagaatactctgaagcacttctttctatatttcctgaaaaagtcaaggttcttgggaaagcccttggaataccagagaacagtgtgagaacatacactgaagctgaaattcgtgctggtgttatttttcaggtctcgaaactttgcactgtacttttaaaagcaactcgagcagttcttggatcgtctgtgtgggatgttcttgttcctggagtggcccatggagccttgatacaggttgaaagaatagctcctggatcattgccatcatccatcaaagaacctgtcgtgctagttgtaaacaaggctgatggagatgaagaggtcaaagctgctggggataacatagtgggtgttattcttctacaagaattacctcacctatcacatcttggtgttagagctcgtcaagagaaagttgtatttgtaacttgcgaagacgatgacacgattaagaacacgaggttacttgagggaaaatatgtcaggttgggtgcatcatccaataatgttgatctttcagttgtttcaaacaaagatgagtgtgctgccatgtcttcagagctgtccagtggaggaaatctatttgcacagcaattttcactaccgctgactacagacaagaagttagaattgtctgagcaaaggagctatacttcaggagcaaatattatgtctggtgtgctcgagctttcagaggcatcaattgaatcatctggtgcaaaagctgcggcatgtggaactctttcagttctttcctcagtgtcaaataaagtttacaatgaccaaggaactccagcagcattcagagttcctgcaggtgctgtcattccatttggatccatggaggatgccttcaagaaaagtggatcactcaaatcctacactaaccttctagagaggatcgaaacagctcaaattgaaaatggtgaacttgatagcctatccgcggagcttcaagccactgtttcacttctttctccatcggaagaaatcattgaatctttgaaaagaatatttgatcagaatgttcgactaattgtcagatctactgctaatgtggaggatttggctggaatgtctgctgctggactctatgaatcaattcctaatgtcagtctctctgaccctagttccttttgcgctgcggttggacaagtttgggcatcattatacacaaggagagcaatccttagccgtcgagcggctggtgtacctcagagagatgcaaagatggcggttcttgtgcaagaaatgctgcagccagacctctcctttgtgcttcatacagttagcccagttgaccatgatcccaagttagtagaggctgaggttgcccctggtcttggagaaaccctcgcttctggaacccgtggcactccatggagactctcatgtcacaagtttgatggcaaagtcacaactctagcttttgcgaatttcagtgaggagatggtggtgctcaactctggccctactgatggtgaagtgactcgtaggaccgtagactacagcaagaagccgttatctgttgatgcaacctttagggggcagtttggtcagcgccttgccgccattggacagtatctggaacagaagttcggaagtgcccaagatgtggaaggttgcctggttggccaagatatatttatagttcagagcaggccacaaccataataa

SEQ ID NO: 18 - DNA, 2260 bp, Zea mays
  misc_feature (1)..(2260): ZmPWD coding sequence
tctactggagcaactggaatctattgagcaatctttgaatgagtctggcttagaagctctctcatcctttctgaaaaccaaaaagaatttagaccaactggaagatgcaaaagatttggatgaaaatggcggcgttcacgttttgctgaagaccttgctgtcattatcttatctaagatcaattctaatgaagggtctggaaagtggccttagaaatgatgctccagatagtgctattgcaatgcgacaaaagtggcgtctttgtgaaattgggcttgaggattattcgtttgtattgttaagtagatacatcaatgctcttgaagctttaggtggatcagcttcacttgcagagggtcttcctacaaatacaagtctatgggatgatgcccttgatgcccttatcattggcataaatcaagtttgcttttcaggttggaaaccaaatgagtgttctgcaatagtgaatgagcttctttcttggaagcagaaaggtctatctgaatttgaaggcaatgaggatggaaagtatatttgggcactgagactcaaagccactcttgatagaacaggaagactaacagaagaatactctgaagcacttctttcaatattccctgaaaaagtcaaggttcttgggaaagcccttggaatacccgagaacagtgtcagaacatacactgaggctgaaattcgtgctagtgttatttttcaggtctcgaaactttgcactgtacttttaaaagcaactcgagcagttcttgggtcgtctgtgtgggatgttcttgttcctggagtggcccatggagccttgatacaggttgaaagaatagctcctggatcattgccgtcatccatgaaagaacctgtcgtgctagttgtaaacaaggcagatggagatgaagaggtcaaagctgctggggataacatagtgggcgttgttcttctacaagaattacctcacctatcacatcttggtgttagagctcgtcaagagaaagttgtatttgtaacttgtgaagacgatgacacgattaaaaacatgaggttacttgagggaaaacatgtcaggttgggtgcatcatccaataatgttgatctttcagttgtatcaaacaaagatgactgtgctgccatgtcttcagagccatccgctggaggagatctatttgcacagcaattctcactattgactacagacaagaagttagaattgtctgagcaaaagagctatacttccgtagcaaatggtatgtctggtgtgctcgagctttcagaggcatcgattgaatcatctggtgcaaaagctgctgcatgtggaactctttcggttctttcctcaatgtcaaataaagtttacaatgaccaaggaactccagcagcattcagagttcctgcaggtgctgtgattccttttggatccatggaggacgccttgaagaaaagtggatcactcaaatcctacactaatcttctagagaggatcgaaacagctcaaattgaaaatggtgaacttgatagcctatcctcgaagcttcaagcaactgtttcacttctttctccatcggaagaaatcattgaatctttgaagaaaacatttgatcagaatgttcgactaattgtgagatctactgctaatgtggaggatttggctggaatgtctgctgctggactctatgaatcaattcctaatgtcagtctctctgaccctagatcctttggagctgcggttggacaggtttgggcatcattatacacaaggagagcaatccttagccgtcgagcagccggtgtacctcagagagacgcaaagatggcggttctcgtgcaggaaatgctgcagccagatctctcttttgtgcttcatacaattagcccagttgaccatgatcccaaattagtagaggctgaggttgcccctggtcttggagaaaccctcgcttctggtacccgtggcactccatggagactctcatgtcacaagcttgatggcaaagtcacaactctagcttttgcgaatttcagtgaagagcttatggtgctcaactctggccctaccgatggtgaaatgagtcgtaggaccgtagactacagcaagaagccgttatctgttgatgcaacctttagggagcagtttggtcagcgccttgccgccattggacagtatctggaacagaagtttggaagtgcccaagatgtggaaggttgcctggttggccccgatatatttatagttcagagcaggccacaaccacaataa

SEQ ID NO: 19 - DNA, 3621 bp, Oryza sativa
  misc_feature (1)..(3621): OsPWD coding sequence
atgacgtcgctgcggcccctcgaaacctcgctctccataggcggcaggccgcgccgtggtctcgtcctcccgccgcccggagtcggtgcgggtgtgctgctccgccggggagcgatggcgctccctgggcggcgcggcttcgcgtgccgcgggagatccgcggcctcggcggcagagagaacaaaggagaaaaagagaagagattcttcaaagcagccattggtgcatctccaggtttgtctagagcaccaggttaagtttggtgagcatgtaggcattatcggttccacaaaggagcttggttcatgggaggagcaggttgaactggaatggactacaaatggttgggtctgccagcttaagctccctggagaaacacttgtggagtttaaatttgttatatttttggtgggaggaaaagataaaatatgggaagatggtaataaccgtgttgttgagctgccgaaggatggtaagtttgatatagtatgccactggaatagaacagaagagccattagaacttttaggaacaccaaagtttgagttggtcggagaagctgaaaagaatactggcgaggatgcttcagcatctgtaacttttgcacctgaaaaagttcaagatatttcagttgttgagaatggtgatccagcaccagaggccgagtcaagcaaatttggtgggcaatggcaaggaagtaaaactgttttcatgagatcaaatgagcatctgaataaggaggctgataggatgtgggatacaactgggcttgatggaatagcactgaaactggtggagggcgataaagcatccaggaactggtggcggaagttagaggttgttcgcgggatattgtcagaatcttttgatgaccagagtcgtctgggggcccttgtatactcagctatttatctgaagtggatttatacaggtcagatatcgtgctttgaagatggtggccaccatcggcctaacaaacatgctgagatatcgaggcaaatattccgtgaacttgaaatgatgtattatgggaaaaccacatcagccaaggatgttctcgtgattcgcaaaattcatccctttttaccttcatttaagtcagagtttacagcctctgtccctctaacacgaattcgtgatattgctcaccggaatgacatcccacatgatctcaagcaagaaatcaagcatactatacaaaacaaacttcatcgtaatgctggacctgaggatcttattgctacagaagtcatgcttgctaggattactaagacccctggagaatacagtgaaacatttgttgaacaattcacgatattttatagcgaactaaaagatttcttcaatgctggcagcctatttgagcaactggagtccatcaaggaatctctgaacgagtcaggcttagaagttctctcatcctttgtggaaaccaaaaggagtttggaccaagtggatcatgcagaagatttggataaaaatgataccattcaaattttgatgactaccttgcaatcattatcttctctaagatcggttctaatgaagggccttgaaagtggccttagaaatgatgcgcctgataatgctatagcaatgcgacaaaagtggcgcctttgtgaaattagtcttgaggattattcatttgttctgttaagcagattcatcaatactcttgaagccttaggtggatcagcttcacttgcaaaggatgtagctagaaatactactctatgggatactactcttgatgcccttgtcattggcatcaatcaagttagcttttcaggttggaaaacagatgaatgtattgccatagggaatgagattctttcctggaagcaaaaaggtctatctgaaagtgaaggttgtgaagatgggaaatatatttggtcactaagacttaaagctacactggacagagcacggagattaacggaagagtactctgaagcacttctttctatattccctgaaaaagtaatggttattgggaaagcccttggaataccagataacagtgtgagaacttacacagaggcagaaattcgtgctggcattgtttttcaggtatctaaactatgcacagtacttcagaaagcaattcgagaagtacttggatcaactggctgggatgttcttgttcctggagtggcccatggaactctgatgcgggtggaaagaattcttcctggatcattaccttcatctgtcaaagaacctgtggttctaattgtagataaggctgatggagatgaagaggtcaaagctgctggggataatatagttggtgttattcttcttcaggaactacctcacctttcacatcttggtgttagagctcgtcaagagaatgttgtatttgtaacttgtgaatatgatgacacagttacagatgtgtatttgcttgagggaaaatatatcagattagaagcatcatccatcaatgtcaatctctcaatagtttcagaaaaaaatgacaatgctgtctctacagaaccaaatagtacagggaatccatttcaacagaaactccaaaatgaattctctctaccatcggatatcgagatgccactgcaaatgtctaagcaaaaaagcaaatcaggagtgaatggtagttttgctgctcttgagctttcagaagcttcagtggaatcagctggtgcaaaagctgctgcatgcagaactctttctgttcttgcttcattgtctaataaagtctatagtgatcaaggagttccagcagcctttagagtcccttctggtgctgtgataccatttggatcaatggaggatgcgctcaagaaaagtggatcactggaatcctttacaagccttctagaaaagattgaaacagccaaagtcgaaaatggtgaagttgatagcctggcgttggagctacaagcaataatttcacatctttccccaccggaggagactattatatttctcaaaagaatcttcccacaggatgtccggttgattgttagatctagtgctaatgtggaggatttggctggtatgtcagctgctggtctctatgattcaattcccaatgtcagtctcatggacccatgtgcctttggagctgcggttgggaaggtttgggcttctttatacacaaggagagccatcctaagccgtcgagccgctggtgtttatcagagagacgcgacaatggctgttcttgtccaagaaatactgcagccagatctctccttcgtgcttcatactgtttgccccgctgaccatgaccccaaggttgtccaggctgaggtcgcccctgggctgggtgaaacgcttgcttcaggaacccgtggcaccccgtggaggctgtcatgtaacaaattcgatggaaaagttgccactcttgccttttcaaatttcagtgaggagatggtggtgcacaactctggtcctgccaatggagaagtaattcgtcttactgttgattacagcaagaagccattgtcggttgatacaacctttaggaagcagtttggtcagcgactggctgcgattggccagtatctggagcagaagttcgggagtgcacaggatgtggaaggttgcctggttgggaaagatatttttatagtgcaaagcaggccacagccatag

SEQ ID NO: 20 - DNA, 24283 bp, Sorghum bicolor
  gene (1)..(24283): SbPWD gene
atggcgtccctgcgaccgttcgacccctcgctcgcggcccgccccgggcctcctccgccagcgaggccggccgcacgccgccccgtgcctgcgccaccgctcgctgccccgtttgcgtccgcgctcatcttccccgtgcgcccgcgaatcccagggaggacgagagggaccggagtcgcggcatcaacaaagcatatcaccaggtgggacggtcctatatctcattcttgcctctcaaccaaaccaaggccttgtttacttccactcaaaaatccaaaatttttcaagattctccatcacatcgaatctttagacgcatgcatggagtattaaatatagacgaaaataaaaactaattgcacagtttggtcaaaattgacgagacgaattttttgagcctagttagtccatagttagacaataattaccacaaacaaacgaaaatgctaccgtgtcgcgaaattttttcgaactaaacaagtcccaaaccaaacagcacaaaagagatcaccccgttcccatcccacgaaccaaacactgctaaaatggtactttgagtaaatttcgaagtattcaaacatctctagttagataatttaattctaatgttgccagaatatacttatcggaactcatttaatttgataaaagtattgtaattcaattcaatgctgcttcattgtacattttgatcagttttatatttctttttcaattaattcaaacgactctaaatgaaattccatgtctagctttccatttactacttaatgtaatgtcttctgcccatatgcattgatgtatgacaagtagatcaccttttatgaactactccatggatctagtcacagttgtttcttgattgcaatatatttttcttctctggcctatgatcattatacagcagaaaagatgaaacagttacttgcaaattctgctcttacacacatgcaactctctgagttctgaaagtctgatttccagtagagtttgttggctacactcactgtttttattctacagaacaaaggaggaaaaacaaacagatccttcaaagcaggatatagtgcgtcttcatgtttgtctagatcaccaggttatgtttggtgagcatgttggcattattggttcggcaaaagagcttggctcatggaagagtccggttgagatggattggacaccaaatggttgggtctgccagcttgatctccctggagaaacacttctggagttcaagttcgtggtgtttttgaatagaggcaaggacaaaatatgggaggatggtgacaaccgtgtagttaatttgccaaaaaatggttcatttgatatggcatgccactggaataagacaaaagagcctttaaatcttttaggaacatcagagattaagttgtctggagatactgagaaggagaaagatgaagatgctaaactatctcgaaatattgctctagaagagatgggaaatatttctaatgctggggatggcgatctaacaccaaaactcgagtcgagcacacttggtggcctatggcaaggtagtgatacagttttcatgcggtcaaatgagcatcgcaataatgagagtgataggaagtgggacatgactgggcttgatgcagtatcactgaaattggtggagggtgataaagcatcaagaaactggtggcggaaggttagttggattaattccctattttttcttgtgaaatgggtacagtattccatgtgggtttattcttttgatcttaacacctggctgtttaccttctggtagtagttgttgtagatgtaattcataataattgttaactgtgataactgggatctcttgtgaagctattatctagaagtatagtgtttattgcccagatagatttttttgaagggacttaaagatagtgttatcattttttgggatattatctaatatatgctaaaatttctaggcaaggctaattccatttgtagaatttgtaaagcttccaatcgagattggactttctttactaagtaatataaaaccagggtataactttttgcacttctggagaaagaaaactaattttatctactggactatctatgtgaattcactttgctatgtttctgcagttggagcttgtccgtgggctcgtatctgaatatgttcatgatcagagtcacctggaggctcttacatattctgcaatatatctaaaggtccccccctcttgcaccttactgtgctgttagtcaataggtgccacagatatccaaatattccccttgagctttgtgtctggatacagtgatattggttaatggtttttgtaacattctcaatatcttgtcttcattgcagtggatatatactggtcaaataccatgctttgaggatggtggtcaccatcgacccaataaacatgctgagatatccaggcaaatttttcgtgaaattgaaaggatatactatggggaaaacacatcagctcaggttgatcgcttcattcctcatagtagttgtgacatcaacattgtcctacaagtattttattttgtgtcactacttatttctataaaaaagaatgccccatgactttgcactaaggtgaaactagctatgaaaaccccaaaccctggcttcaccgtacagggccacactataacctgagccggtgaccattgtcactaccctgagatagtaccgcaccattatggtgccttgccactactttttttttgggggggggggggggggggaggcagggaggtttttgtttttttttatcttgctgatggaggaggtggcaatgaccagtgaggattttcaatggtgggcgaccgatcatctctctgtcttactgtctacacatcatgcgctggtctcgtttcccttcatgcctcggcggaaaatctcttgttcgctgcggacattgagttccaatgcattcctgctcatgtctaggatcaagacacgtggagggtgggtgggtgtggaaggtgatggttaggtccttgtcttgtttagaaccacccccaccctttccttctcggttagggtgggtggatgtggtgttgttttgttccgcgagctgggtttctttctaaatccagctcatcttgtattcctctacctcctgtgtagtttgagagaaaaaaagtaggtgaccagaagtccagaactaccaaaaccaggaaaactcctggcgcatttttgcttcaggagaacacaagctacattcatttgtgcctggctagaacaccacaatgatattcagacttgagctgttaaaaacacaatcattctgatgtttccagatttcctaggacacactaatgataactgaattgaggccttctctgatccccttctgcacttctttgattgcccggtactaccagcttgactctgctgacagaggccggcgcaatggaatgcaatcccaatccttggaagattctgtaccatacctgtctggcaaaggctgaattgactcttctgcttgatcacaaagtgggcaagcagccagatgaggaagtcctctcttggcaagacgagtgtctgtccaacaacggttgttcattgcaagccaaatgaacttgcagtgaggataagcccatgacttccagattcttttcatcggagcaaagaaagcattttgtaatctttactagaatatattgtaagttgagaaaatatgtagagtagtagattgcattagagcttgaacaggctcaaatgttccattgatgaataggagggagggagggaggtattagccgaatggtaataaatatgcgccaggttgatatgttgagtaaggtacatgtggataggggcggaaccgtcctccaatatccttgccgaatacaactcaataggtgtgccgggcttggagtccaaggcaacacagctaaataggatggcagctgggctacggctgcttggccagcccaagcccatatttgtctaacatatattccttaatgaagacaaatattattcaattttgtaattctgaccatttacattttgattcatattaatacaggatttgcttgtgatacgcaagattcatccttgtctaccttcatttaaatcagaatttactgcctctgttcctctaacacgaattcgtgatattgctcatcgtaatgacataccacatgatctcaaggtgatgatcacatttcacagttttggataacttcctcaatggaattcttgcttagtcatcttctattatcaacagcaagaaatcaagcatactatacaaaacaagcttcaccggaatgccggccctgaggatcttattgctactgaagccatgcttgctaggattactaagactcctggagagtacagtgaagcttttgttgaacaattcaagacgttttatagtgaattaaaagatttcttcaatgctggcaggttgtctaattcctaatttgcccacattttctgcattcagaaattttcatttcactgtttgctataataaactgctcatattaaagctactattctttcaatcatgctaatcctgatatcctatatcctgcctaaattagccaggttgtccttggtctctagccggtcctgtggcccagccgcaccttctggccgtgtgcagccctcttgcaccgccgtctgtatgtgcaccctcacgtgacaaagatagtgacatcagttttgagtttctattcataacgacttgtcaccagaagtaccaatacaggcatgcattggtgatggtgattattgaaacattgtaattcacattactaggctaaccctagacagggtagccatatagttccatacatgggcctcatgggcctagattactcatactccaacaggcccccgcagtctgaactaccggcgcagcggagttgcagactggactggaaaagaagtacactcacgagcccccccacagacacaactagccaccggtaatgttgaggctggagcggaactcagcgaaggtcgaggacgggaggcccttggtgaagatgtcggcgaactgggaggtggtcgggacgtggaggacccgaacatcgccgatggcgacccgatcacgaacgaagtgtaggtcgatctccacatgcttagtcctctggtgctgcacagggttggtggagaggtacaccaaactgacgttgtcgcagtagaccagcgtactcctagagagagggctgtgaagctcggcaaggagctgccggagccaggaagcctcagccacgccgttagcaacagcgcggtactccgcctcggcactggagtgggagacaaccggctgacgcttggacgaccaggacacgaggttgccgcctaagaagacagcgtagccggaggtagagcgccgagtgtccgggcacccggcccagtcagcgtcagtgtagacgaccagctcggtgaagaagcaacccgtagtcgacagtgccgcggaggtagcggaggaggcgcttgagagctgtcaggtggggctctcgaggatcatgcatgtggagacagacctgctgcacggcgtatgtgatgtccggcctggtgaaagtgaggtactgaagtgcaccagcaagactccggtacgcagtggggtctgatactggattgccctcggcctctgacagcttgccctgagtgtcaaccggagtggggcagggcttgcagccagtcatccctgctcgctccaggatatcaagagtgtactgccgctggtgtagaagaagcccagtgggatgaggctcaacagtgactccaagaaagtgatggaggacacccagatccttcagagggaactccagctgaagagcgctgatgatgcggcgcaataatgaaggactggaagctgtgaggacaatgtcatcaacatagagtagcaggtacgcagtctcggctccatggtggtagataaacagggacgtatctgacttggcctccacaaaccccagtgtcaccaagaaagcagcaatccgagagtgcatgcccgaggggtctgcttgagaccgtagagagacttgttgagccggcagaccatgtctggacgagaggagtcaacaaatcccgctggctgactgcagtagactgtctcagtaagatgcccgtgcagaaaagcattcttcacatccagctgatgcaccggccaagagcgagcaagagccagagagagcactgtgcggacggtcgccggcttcaccacaggactgaaagtctcatcgtagtcgacctcagggcgctgagtgaaaccccggagaacccaacgagccttgtatcgctcaagggtgccatcagcccaccgcttgtgagtccagatccacttgccggtgacaacattggcgccggacggacgcggcaccagatcccaagtctggttggcaaggagcgctgcgtactcctcttccatcgcgcggcgccagtgagggtccaacagggcggcgcggacggacgagggtacaaaagagacctgcgagtcgccgggcatcgccgcaagagcccgggaccgcagggtaccagccgcgtgccgcgtcaccatcgggtggacatgacgcgggtcgcggtgaagaatcggcgggtggtacactggcggcacagcacgggcagtcggtgcccacggtagcggagtaggcgtggccggcggagaggaggccaccggtggtggcggtgtcagcggtggaggagacaccaccggtggcgatcgaggcaggggcgtccctggcaaaggagaggccacccccggtggcggaggaggcgggaccgtctgcgcccggcgctggtagacgcgcaccggctgggcgaagcgcgccggaggtgcagcaggcaccggctgggtgcagggtgccggaggaacggacaccggcgtcctcgggcccgcgtcaggagtagtcgcaggaaccacccggaggggcgtggccaccggacccgtgcaaggcacagaggacctcggtggagcagatcctgcaggaaacagtagaggtggctgggccaccgggtcagcgggacacgacgagaagaagtcgaggtcatgagcggaagccggtggggtggtggtggagaaagggaagacaagctcatcaaacaccacatggcgagagatgaggacgcgacgagaggtaagatcatagcaccggtaccccttgtggtctggggcgtacccgaggaagacacagagagtcgaacggggtgccagcttgtggggagcaatggccgtggtgttagggtagcacgcacacccgaagacacgaaggtggtcataccgaggaggggtgccgaacagagcatggtgaggggtaggagcgggacaagcagtggaaggaaggcggttaaggagataggtggaggtgtgcaggctctcagcccagaagcgagcgggtagggacgcctggagaagaagggtgcgtatggtgtcgttggtggtgcgaatcatgcgctcagccttgccgttctgggaggaggtatacggacaagacatgcgcaactggacaccgtgtgagagaaagaaggcacgggaggtggagttatcaaactcccggccattgtcactggacggccttgatggtgaggccgaactgagtagacacccaggcgaaaaagtggagaagagtggggaaagcatcagacttggcacgcagaggaaaagtccaagaataatgagaaaaatcatcgaccaccactaaatagtatttgtagccagaaatgctgaggacaggagaagtccaaaggtcgcagtgaacaagatcgaacacccgagaggcatgagaagaagaggactgaaaaggaagacgaacatgacggcccagctggcaagcatgacacaagggctcatcgtgagtccgagggcactgaatgtcagaactacgactcagctgtgtcaaagcatcacgaccaggatggccgagacgacggtgccaggtagtggaggaaggtgtggtggcaaaggcagttgacaaaccaggaggcgaggtagaggacgcagaggtcggaaactgaagggtataaaggggccccgtgctgtcgcaacggagaagaggccgccgggatgccaaatccctcacagtaagaccagaagaatcaaactcaaccgagcaggaattgtcagctgtaaaccgacgaatagaaagaaggttgtgaaccatagaaggggcaacaaggacgtcgggaaggcaaaaggagccatgagtgccggcagcacccacagaggtgacaggaagacacgagccattggcgaccatgatggacgaaggatgagaggaagaaggaggttgaacataggagaggatacccgggtcgggagtggtgtggtaagtggctcccgagtcggcgacccagtgaggtccgacaagaggaggtggagtcatggcgctgaaagagttggccaaggccgtcgggtcccaaccgacaggcccgggcgagacggcaggaggtggggcccaggagaagcggaaagagaccctggaggagcataagcgagcatggccgccgccgggtgaggaaacacaccgtcgggaggtggaggccacagaggtgctgagtgaaaccccggaggagctcctgcaagcatggtctcggcgagcaaagctcaccacgtcgaattcggcggcgacggcgacggcctcctcggaccccccaacccccgctcggcccgaggggagggccaagaagagaagcccgggcggcgacgagggcggtggcgagggccgaggcagcagtgccatggaggggcgcaccggttcccgcagtgctaggagaaccaggaaccgcgtccagagtaggggccactcccatgggcggagcaggcacggccgcggtcagagcagggaccgcagcgccagctgcacccacgctcgtggcacttgcgggcgctgccaggaagatagccgaggcagccgtgctgtgaacagagaggcagcgggcagtggcgccggcgctgggaaaaatggcagcgctgggagccgcgcgcacacctgctgcggcactggggggccgcgcccacgcccgcggcggcgctaggggccgtgcccgcacccgctgcggcgctgggggccgcgcccacgcccgcggcggcgctgggggccgcgcccgcaccggctgcggcgctgggggccgcgcccgcgcccgccggagtcgcgcccgcgctcaccgcgcccgcgttgaatcggggccgcgccagggccgctgcgaagctggggctgcgcgtgcgtgccggacctgcgcctgcaccggggccggccgcgcttggagagggagagggaggagcgccggccatggctcgccggcggcggcggcgccggcggctgagcaggtggcggctgggaagggagggagggaggaaagaaaaccctagcttgataccatattgaaacattgtaattcacattactgggctaaccctagacagggtagccatatagttccatacatgggcctcatgggcctagccgcatgggcctagattactcatattccaacagtgatgaaggaaaaaacattgcagcaaaagaatcaaggtcattggagtggatctgtgtgttctcagaataacttgcctcaaagcctaaaattattgtactagaaatggtttatgtgcaaaactaagaaagttgaatctagaataattaaatactaagagcagttaagagaataaatccactgtatgccactagagaacttcctagctgtgattatcatcaaataagtccattttcagtccatgccatcatggttttcatttttctccttgaacacataggagagttgcatatcactatattaagcagaaaaatggttaaggtccatacaacacacctgcacacccaacacacaagtcttaacccaaagacctaagaaactccttgagctgtggccaagaagtaagaaataccatgggaaggtgaatttcttccctaacgagcaggagtgtttcagcaattttgggaagatggttttcaatttgattttgatacttttctcagtccatgatatctggcaatgacacggagtaaagaaattcaaaatcttatggtatggaattaactctgacttattccatggaaagtcatgaaacaaagaaatatccaatgacaaataattaatgtcaatataaattcgcccttaaaccttcagactagaacagaaataattttgtgaatcatattttattttcaaccatgcaggcgaataatataaaagaagcttttatgctgcatcatcttttctttgtactctgtggttaaatactttttgaaataattatgtgattatttgatactgtaatgtgggctttgcagcctactggagcaagtgcaatccatcgagcaatctttggatgagtctggcttagaagctctctcatcctttctgaaaaccaaaaaggttagttttttttgtgaatttattcttcactccctaatatagacaagtacaataagtttgaagttgttaatttgttctaccatcacgtatttgctatttctatgtttcggcaacttcatagagaagagtagcctcatctttgccaatgtacttaagttctgttagtattcatgccttgctgggttcgatgctatggctagatggataatgttattggccctggtgtacgccctgcaaccaagattcaagtccctttaaacttgaattttggagcctattcttcttaatatctgactaagttcctcctagtgtcagtctttttttaataagtaaacagcttttactgctttatctttaaccagtttactgagtgatggacctgctgctcaccagtgtaatggccatttcatacgtgtatatgtgattctattgattatctcagaatttagaccaactggaagatgcaaaagatttggatgaaaatggtggcgttcaagttttgttgaagaccttgctgtcgttatcttatctaagatcaattctaatgaagggtctggaaagtggccttagaaatgatgctccagatagtgctattgcaatgcgacaaaaggttattttgtcaaaacacaattgagaaagtatgggttgaaattggatgcatgtattttcagttaaattgattgttgaggttttgcagtggcgtctttgtgagatcgggcttgaagattattcgtttgtattgttaagtaggtaatgacatagttgaaattaaatttgtttcttttttcaattatgatgcttccgtacatacttagtttctcatggaagcaaatccggtttttaccataacagatacatcaatgctcttgaagctttgggtggatcagcttcacttgcagagggtcttcctacaaatacaagtctatgggatgatgcccttgatgcccttgtcattggcataaatcaagttagcttttcaggatggaaaccaaatgagtgtactgcaatagtgaatgagcttctttcttggaagcagaaaggtctatctgaatttgaaggtacaatttctcctttactatatgtcatgcatgaatgtgcatccctacttgtgttctcattgtggtgagtacccttcaactattgttgtcatgtacataggcagtgaggatggaaagtatatttgggcactgagactcaaagccactcttgatagatcacgaagactaacagaagaatactctgaagcacttctttctatatttcctgaaaaagtcaaggtgagtttactgaatgaagagtagatgagtcctgtgatcataagtttatcatatgctattctgctgtccacctattttttcccctcaaatatgttattggctgttactaaccttggagatttgagaagatgagcactccagtagtggagatgactatatatataggagcctcatggaccatataggcctatagtagatggactttcatacactttaacaccctgcttcaaactcaaggtggaagtgcgggatctgaaccattgagtttgagcaagtgaagctgatgctgctcataggtttgtgctttagcgaaaaaatctgccacttggtgaagatctcaacatattgagatgacgttggcacatggagaacgtgggcaccaccgatgggaactcgctcccaaacaaagtgaagatcgatctcaatgtgtttggtgctttgatgctgaactgggttggaggacatgtagaccacactgatgttgttgtaaaccagggtagcacggcagggcggtgagtgaagctcgcaatgaacaacattagccacaatgcggtactcggcttctgcattggacggagacacagtggtttgctttttggagggctaggacacagggttgtccctgaggaagaccgcatagcccgaggtggacctaagatgtagagtgcggtgaatgtacctcaaaatgcatttgagagccgcatgatgagatttccgaggatcatgcatatggatacatacttgttgaaaagcataggggatatccggtcgtcactaaccgaggcgctatccatggccgacaagtatgtacctattctgcaagagaaacaaaccgttggcattgcactgaacttgcatcctaagaaagtgatgtagctcacccaggtccttcatctacaactcttgttgcaaggcatgggtgatgtggcaaaggagagctgctgatgatgcagtgaggacaatgtcatcgacatagagaagcaagtagatgacgttgcctcctcagcggaatacaaacagcgaaaagtctgacttggcttccacaaagccgagtgagagcaagtaggcggtgaattggcttcgacacatagcctagtataaaaagcaaactaaaccctaaactagatgtctcttgtaatatgaaattctgcatgtttaatatattgttttgacaccatggatttgcttttactctccaaatggtgcattttgtgatgggggacctgatgtggcgtagaggagcgcaatgtcttggttgggaaaatgttaaggagcagtgtggtggtactaaggctttcaacccaataacgaggagggagactgtcctgaaacaagacagagcggacgacattgttaagcctgtgaatgggaaggtgtacttgtgcaacttccttgaggataacttcgtcacggacgtggcaggagtacttctcgaggatgagaaggatctaatggctccaataggtgtaattgtcggagttagtgttgaggatggcggggatgaggttgcggatgttctacacgtcgactgcgtgagcgtgcaaattgatgatggcaacgacctcatggaccaatagcacattgcgaaggtgctgttgaggaccatccaggagtggttgacttgaagtccttgtcggttgcgatgacccgtttgtgggctgcacgggtgagggtgtggatggccgctgtgacggcccttttgttggccgcacggttgagggtgttgctagcacgcacgacagccatgttgcacgcttgggcggcagtggaggcttccctcttggcagcttgggcatgagcaagggaagcagttcctctagagttggtgcttcttggtcacgagcatgggtaactagcaggtcaatcagggccaccctccagtcacacaagtgtagaggcaccaacacaactgcaggggcaacaattggagaagacttgtttatgagcaagggccacctcttgcgtggccttggccttgtggtggcaggcgacaacactatgcctaggggtgtctgcgtcggcaatggtagcagtgttcgcaatggctgctgctgtcgtagcggccttggcctccgcatcagcagctgtggttgcagcgaggttggcctcattctcggaaggagaggcggcgccgcagcagcgttggcctctgtgtctgtagttgcaaggaggttggcctcctcatcgatcatgagagtggtggagacagcagccaagggaagaataggggacttctggatatggtggacgcaacatgaggggatcaagcgtgggaattgttgcggggcgaggggccagcccatgatgaggtaagttgcgtgggcgcactagggtagtggaaggattagggtttaacatcagtgttatcctaaatgctaaacgcttttcggatataaacactagggtatctattaacctggggattagctctcatccaaactggcttatccgacgatcggccagactagtccaccccaaaggcaaagccaacatctcggctgaccctaaacgcgtagcctacaccttgcctgaccccaaggtttgggtttcaattcgcatgacctcgagggcatggttcccaacgaccccaagggcatggtttctgattcgcccgaccccagggctgtgggctccggctcgcctgaccccaggggcgtgggttctgtctcgcccgccccccacgcgggagttctgcccagtccgatggtgatttttgtgtgggagcccctggccgaaggcagaatgctcttggacaaaggtacaacatgcactagaggcgttagaggcgaacgggatggctcacctcgatgtgacctcggcccagatcaggtgtagccaatgagctgtacgtagccacagggctccactgtggagttaactcttgtaccacacttgtactttgtccacaaatatgttacaaggtgtcattttgtcacctaaaatgacatgggacttgcctaagcacccggttgaccatcccgcatgtcccgggtgcgtgagatgtcgtgtacgcccctaatggatgccacactgccgttgtggttagtaggacgatgagatggcacctcccatgtcaaagctacaggagcggaccagctcgtcagcaaggaggagagatgacccctggagacctatttttctcttcttttcctcttttagcctctttgtcttcttacacatgtacaccagtcccttcccttgaactataaaagggaaggtggggcatcccttctgggacacaacgaccaccacaatgaaaaacatgaacacaacattctagcccacattcacacactgctctcaagcaccatagagacttgggagcccactccctctctcgactgtttgtaacccctactgcaaacaacctcgcaagtaaacatgagcagctcgccactagacatagggacattccgcctgaaccagtataaatccttgtgtttgtgcaccatccgagtccagaagtgcagatacaaatagccggtcgcggttcaaaacaccgacaatgctaaaccataaacagtaagtcatctactatttagccattattcgggctaaacggccaattaaacgggcagaacagatgtttaaacaggataaactgtcaattaaatggaaatgatgtaccaacatttagcatttaaatggtgtgtaaacgggctaaacgatcgttaggcgaataatgtttaacctagactagtgatcacagttatttggattggaccggactggcggtccgaccggtaaaagaccaaaccggagccctagccggttcggtctgcctaaaagatcggtatgcaaatgaaccggtattaaaccattgaaccgccggtttttttggaaaaccagtgaaaaaccgctcagaaaaccggacattgggctgctggagccggtgacatcgcgggcgcagagcctgtggtcaccgagaggggtggagaaaatattgaaaaaaagggctaaagtgactgggaagggaatcgaacctccaacctcagcttttgagagcagcaacgccaccactacgatatgctggtgtttgtgtctttgaacagatcacatagtatttgaaccgtattgaaccggtggtctaaacggttgaaccaatcaaaccgtgaaccaagatgttcaccggttcgatctccggtccagtcctaataactatgctagtgataccatgaaagcaaaggtattgcatgggaaaacaacagattgattagggctgtagagtacaggcacatatataggcaaggatgatctagggttggtttatagaaagtatggccactatcggatatcattgatcaatctatagaaaaccatgacaggctctaggcccagatgcgtatttgtctaacagtgacagtgagataaacaaggcttcccacaatatgacgatatctagatccccaagtggtgttccttcagtagggtgaaggtccaagtgaagatcaataggtgttgtagtcgtttgattatcagtaatgccataacgggcaatatgatcttggaatgagagagatagtatcccttagtagaatgcaacacctcaattctgagaaaataacagagaggcccaaatcagacatttgaaattgctcactgagttgcttcctcagaaaatgtccattgcttattgcttgacagataaaacatcatgatatttgtccatacctctctggcagaacacttgatgggaatgttgccaatcatcaccgatgatttaggttaacttagtgtattactactgcatctttattgcaaagtaatatgctttagtgtacataatataaatattcgagccaataggatcaaaattaccagacataaacattacataacgagggttgttccacatgatctttgcttatttatttgcatcatttttttttgcttcgctcatgggttaggaagctagaaaagatctgtaaatgtggttggattgcaagttacaagaaggtgggagcaggacatatttgtatgaggaagatacatgcagtgtgtccaaaaggaagtgaaaataaggatatagatgcagtatgtccaaaaggatgtgaaaataaggatatagatgcagtatgtccaaaaggaagtgaaaataagtatatagtactagattatttcatgcttaatccaaaataaatttgtttccttatatgaggaattcctaagaaataaagtacaaaaaattagagaccgatttcaacactttaaacaaacattggtgcatgctatgttcaatagaacataagccaacatttccatttattctcacactttaactttcttgtgaattgtgggtaaattttcagattgattgtctacatatgtaggttcttgggaaagcccttggaataccagagaacagtgtgagaacatacactgaagctgaaattcgtgctgggtaatgttttctttggagcaacagaagagtactaagtgcttctgcacattgtttcgacgatactgatatttagattaacatcaatctgattgatgtgaatctaactatttagatttgttttagtgttatttttcaggtctcgaaactttgcactgtacttttaaaagcaactcgagcagttcttggatcgtctgtgtgggatgttcttgttcctggagtggcccatggagccttgatacaggtgtgggcaatttccatttgctccttttgccctgttctttttttactgagatgtaattcgaaacatgctgcggtatgacaagatcaaacattttatcattcaaatgatcagcttatatactgaacaattgtcagtcacacatggtgggtattagagatatacatagatatatattagatttatgcaccacttaagcttcattgaattattaaaaagagctaaaagattgatttgatgataattaataataaatcattcatgtaagttgttgtaaaaaactgaagcatagaccataagacaggtttctgtcagaccaggatatttgatcttagcatttttcagttatgattcataagttgggcttgaccttggttcattaaaaattctggcctacccttgagtctttaaaaaattagactggtgggaggagacatctcctgggcattttaattaaaactgaccctagtctcttacccatctagaatggccacaaaggttggtttcacaatcgacaattacatcctgttggtggcagctatttagggtatagagtgtgagccaacgaggggcctttattagcccagcctgaaattcactcacatggggagtcgaatgtaggacctatgttgctacttgtgagctcttctaaccagtcaagttgcaggctcgttcacccttttagtctttaaaaccatctcaacccatccttgcttgccatatttaagttgaaaaatcatgtgtttatagcattgtttctttggtcatagttcattttttcaggttgaaagaatagctcctggatcattgccatcatccatcaaagaacctgtcgtgctagttgtaaacaaggctgatggagatgaagaggtatctataaacaattaaatccttggtttgttgttgtcttgacaacttcctgatatcgcaaaggtttggctcctcatttgacaggtcaaagctgctggggataacatagtgggtgttattcttctacaagaattacctcacctatcacatcttggtgttagagctcgtcaagttagtaccaaaagcctcattttatttaattatggtttccctttttaatgaaatccactgcacttttttgaaaaagaaaaaaaagaatgctacttacatatgtttccaggagaaagttgtatttgtaacttgcgaagacgatgacacgattaagaacacgaggttacttgagggaaaatatgtcaggttaggttctattttactaacatatcattccattctgatatggaccgtgttgctcccatgtcatggaaaaaagattttcttatttcttgaatgaacatatttaataattactggtgtgttacaaatcttatatgataatcaactatcataaagaaagttagaacatttcacaatgtgttgtcttatctcaaaattgtataattcagatggaaaatcatatggcgccaggggggctggtgctctcgttctaaaataccatgttgcaatgtttcaaaaatcatcacaaaaatcatgtatttttagctatacttatctttatgtgtgctagatacatgattttcgtgatgatttttgaaacattgcaacatggtacttttagctaacgagggcgctagccccccctgggcaccaaatctgcacttaattcagatttgagttttaaactgttagttgactattctgtggagattcaattgtatatcgatagagatttaattgatttgtttcatttattgcataagaattatttctttgttatattagtagccgtaatgcttccttttatgtcttggtagtgggctgatctaagccaatgtactaatagtacttggagtagatggggctgtactcagccatactcttgtgtaccatatagttggtacaagagttgtatatatactacacctaaggctgttagaatataattataacagcccatattgggcttacagcccattggccttgtactcctagcctgacttgtattagtaccacattgtaacttgtagatgtactgcaagccttccttgggatctctgtcacgcgttctgcggatggcctcttcctgtctcagcgccagtctgctccagcgcgccggcatggctgagtgtcactctacggcaactcctgttgacactcatgccaagctctctgctacggacggcgcaccggtgtcggatgctactcagtaccgcagcctcgccggtgcactacagtacctcacgttgactcgttcggacctcgcctatgctgttcagtaggtttgcctcttcatgcacgacccgcgggagcctcaccttgcgatgctcaagcgtgtcatgcggtatgtcaagggcaccctgtccaccgggcttcacatcggcacaggcaacatcaccaacttgaccgcctactccgatgctgattgggctggttgtctgtgtcttcctcggcgacaacttagtctcttggtcctccaaacgacagactacggtctctcattcgagtgcggaggctgagtatcgtgtgttgcgcacgctgtggctgagacttgttagcttcgtcagttacttcaggggctccatgcacccatctcatcgacgacgatcgtctactgtgataatccagttcatcatcatcgcacgaagcatattgagatagatattcacttcgtctgtgagaagcttgctttgggacaggttcgggtgctccatgttccatcgtctcatcagttcgcggacattatgaccaaagagttacctgtacagttattcactgactttaggtccagtctttgtgttcgtgacactctcgcttatactgagggagggtgttagaatataattataacagcccatattgggcttacggcccattggccttgtactcctagcctgacttgtattagtaccacattgtaacttgtagatgtactgcaagccttcctggctatataatgaaggtcacctcccctgtttagggtgtgcggtgtttctctacaaaggcaatgcaaaaactcagttcagttgccacattcagtttatagagctcaagttcagagcttgtgtgtgctctgtgctcaatcccttctgcctctagccatggtgtgtgtgagtgtgctggtaatcttgctcacctgcgcagggagatcgagggccaacaaggggtatgaggtgtttttctattttgggcctgatcgaaccattctccccatcccttccgctgccctaaactctactactctatttactgcttgcctgggaactatcccaatgtgtgctgcctttagtgttggtcatcacctgggttcctcccctggctgccaccctctttatcctggtctctactagctctagttatcttctatatataagtggattctgtaaccttgttatcaatcaatgaatacatgcagatttttatcttctctcagttccatgtaataaagttgccactcatgtctgtcatgcatgtcaacttggcaagcatgttcgtctacctttttctatttcgtcatcatgtacttctgctccttttgaactattacattgtgatgtgtgaacattccccgtttcgagtgtcactggcaactcttattatttggttatcctagatggctacactcgttacttctggacctttccacttcagcggaaatctgacatccatcagcaccttgtgcatttctgtgcttttgcccacgcacagttcgcactccccgtcaagtgccttcaagctgataacgatacagtttgtgaacaacgccactactagcttccttgcagccaatgacattctgttgcgtctcttgtccctacactttggctcagaatggcaaagctgagcgtagcttgcaccccctccattcttccatgccttcagcctactgggccaaaactctctccacagccacctatcttcttaatcgacacccatgctccgccatacgcaatgagatcccattctctcacctctatggtcagcagcccgacctatcccaccttcgtgtcttagggtgcctcttctacccgaatctcagtgtcacatctgctaataagcttgcttcactgtcctctgtctgcaggctatcgttgccttgatctctcatcgcgccatgttgtgttcgatgccagcatgctattgagcttctccagcgtgttggcatgcctcaagctcttcgccacagccagtgtgcccgtcatcgacccgtccgaataccgcagccttgctggggcgctgcactacctgacactcacctgtctggacctggcctatgtggtctagtaggtgtgcctcttcatgcacggccccaggaggcagaccttgcacgaccctggtctcttcatctacatgtctccatattggcatcggtcctgtccagtttgtcatgacatagtctgatgcagactgggcagggtgcctcgactcctgccactccacattaggctactgcatcttctcaacaaactcggtaacaattctcctaaatatcctccctgcaatccccttcctaaccaacccagcctctggtcaatcctagccatggtttgggctcggtgaacacctagggtgttgcctatatatcggcggcccatgaatgtgtccacaacttattgcatgcatacaagaatagttggatgagtctgtcctattttgaagttacaaatctaaaagttctctttttctaatgatgaaggaatgtgtagaagtagaattttcagttgcatactgaagtactaaacctgactgctaattaagcaccacttagtggtattgaagtagtatgctactgctatgcaccctctatgtgaatatgttggtgagttttggtgttcctttttacaggttgggtgcatcatccaataatgttgatctttcagttgtttcaaacaaagatgagtgtgctgccatgtcttcagagctgtccagtggaggaaatctatttgcacagcaattttcactaccgctgactacagacaagaagttagaattgtctgaggttaagtttcttttgcttcaaatcatctaatcaaagcatgccaatccatcacatcttgctgactgcatgttacaatgcatgtttttacacttgctcctacttactttttttcttttccctaaccctaaggggccttcacttcagcaaaggagctatacttcaggagcaaatattatgtctggtgtgctcgagctttcagaggcatcaattgaatcatctggtgcaaaagctgcggcatgtggaactctttcagttctttcctcagtgtcaaataaaggtaccaatttcagttgagatatccataaaattcatgttgatttgtgttacgtactttgttgtgaatcgataccttacaaggttcacaatatatctctgatgatagggaatcaaggtagttatcatgctcattcgcagagcaaaatgttatgtttaggaatgttcttgaatttgacaagtatcatttataaccagtcaatttgcctggacgttattagtatgttgctgcttattaacagagaaacgtagtaaacagggcagataacttgcattccaccaatccagatttgtagaatatatatatatatatacacccatggtatcattcaaagcaagtaaatctagctgataatgctgtattcctcctttaataaataacaaattattaaacatagtgcttaaccaaggtgatcaagaataagcttagttttcatgtaacaataacagtgaatgttgtgatagctttttatctgctagaatggcaaaaatgatactgttaaggacttaaggtcatttctgctggtcatgtttcttgtagattgtggtgcgaatctagcctagttcctggggtgtggtgtgtgtttgttcctgtactcaggtttgggtccttctagactcgtgcactactttttttctaccttaatgaaatgatgcgcagctctcctgcgtagttcgagaaaaaagatcgtttctgctgcatgatagtgtttatggatccatagaccttgaaacttatgtgagtacaacagaactgcaagcttatagtagtacggctgaactgctttcttgaaagtcttatgttccgtttcctattatctttacattttccattgattattgggcagtttacaatgaccaaggaactccagcagcattcagagttcctgcaggtgctgtcattccatttggatccatggaggatgccttcaagaaaagtggatcactcaaatcctacactaaccttctagagaggatcgaaacagctcaaattgaaaatggtgaacttgatagcctatccgcggagcttcaagccactgtttcacttctttctccatcggaagaaatcattgaatctttgaaaagaatatttgatcagaatgttcgactaattgtcagatctactgctaatgtggaggatttggctggaatgtctgctgctggactctatgaatcaattcctaatgtcagtctctctgaccctagttccttttgcgctgcggttggacaagtttgggcatcattatacacaaggagagcaatccttagccgtcgagcggctggtgtacctcagagagatgcaaagatggcggttcttgtgcaagaaatgctgcagccagacctctcctttgtgcttcatacagttagcccagttgaccatgatcccaagttagtagaggctgaggttgcccctggtcttggagaaaccctcgcttctggaacccgtggcactccatggagactctcatgtcacaagtttgatggcaaagtcacaactctagcttttgcgaatttcagtgaggagatggtggtgctcaactctggccctactgatggtgaagtgactcgtaggaccgtagactacagcaagaagccgttatctgttgatgcaacctttagggggcagtttggtcagcgccttgccgccattggacagtatctggaacagaagttcggaagtgcccaagatgtggaaggttgcctggttggccaagatatatttatagttcagagcaggccacaaccataataa

SEQ ID NO: 21 - DNA, 26390 bp, Zea mays
  gene (1)..(26390): ZmPWD gene
aatatgggctttgcagtctactggagcaactggaatctattgagcaatctttgaatgagtctggcttagaagctctctcatcctttctgaaaaccaaaaaggttagttttttttatgtgaatttgctcttcactgcctaacatagacaagtacaataagtttggagatattaatttgtgctaccaacacgtatttgctatttctatgttttggcaactcaactccatagaataggtataacctcatctttgctgatgtacttaaaatctgttagtattcatgccttgctaggttcgatgctatgtttagttggataatgttattggccctggtgtacaccctgcaacccaaattcaagtcccttttaacttgaatttgggagcctatacttagtatctgattaagttcattctagtgtgagtttttttttaataagtaaacagctgttaccacttatctttaaccagtttactgagcgatgaacctgatgctcaccagtgtaatggccattttatacgtgtatatgtgattctattgattatttcagaatttagaccaactggaagatgcaaaagatttggatgaaaatggcggcgttcacgttttgctgaagaccttgctgtcattatcttatctaagatcaattctaatgaagggtctggaaagtggccttagaaatgatgctccagatagtgctattgcaatgcgacaaaaggttattttgtcaaaacacaattgagaaagtatgtgttgaaattggatgcatgtatttcaattaaattcattgtcgaggttttgcagtggcgtctttgtgaaattgggcttgaggattattcgtttgtattgttaagtaggtaataacatagttaaaaataaatttgtttctttttcaactatgatgcttccaacatacttggtttctcatggaagcactgtgtttttatttttgttgctatggtaccataacagatacatcaatgctcttgaagctttaggtggatcagcttcacttgcagagggtcttcctacaaatacaagtctatgggatgatgcccttgatgcccttatcattggcataaatcaagtttgcttttcaggttggaaaccaaatgagtgttctgcaatagtgaatgagcttctttcttggaagcagaaaggtctatctgaatttgaaggtacaacttctccttttatatatgtcatgcatgaatatgtatccctacttgtgtgctcattgtggtgaggagtacccttcaactactgttgtcatgtacataggcaatgaggatggaaagtatatttgggcactgagactcaaagccactcttgatagaacaggaagactaacagaagaatactctgaagcacttctttcaatattccctgaaaaagtcaaggtgagtttaccaaatgaagagtagatgagtcctgtaatcgtaagtttatcacatcctattctgctctccacctaccccccccccccctttgagtatgttattaaccttggggatctgagacgttgaacacttcagtagtagtggggacggctgttactaaccttggagatttgagaagtgagtactacagtagggagatgactatatatataggagcctcatggaccatatagtagatggaccttcaaacactttaacacttctcatgaagtttgctagccctagctgactcaagcccttagcgccagccaagatccagcaagcaagttcatcactgaaatgctgctgcattttctgaatggagggatgatccccataaaaaacagttctattcctctgcagccaaaagcactaagcacccaaaatgatggcaatgttgatccgttttctcctgtctttccttatgcattggatggtcctccaccattccgcaaacgaatcatcatcagccctaggggagaggtgacacatcccaaaagaagcaaagagatggtaccagaactggcgggcgaagacacaattagtgaggatgtgttgcaccgttttgctttcctggtcacacaaggggcaactgtctgggttctgctggaaaaacttgcatttctcatttctaaccaaaggaaaaacttgcatttctgcggagcccaagacctcaaagtcttttctaggtttcaaaagtgatagaccccctgaagaaggcctgataacatgatttggaggaaatggtcccagaaaaggtatgcctccatagatattgatcatctttagcaatgaggactgaggagacattctccaataaattccaaaggagaagacactgttggatacctgttatggaaagcacctgtttgatatcaccgacccaacctttgttagggatggctttaagcaactgttctagagctagccaccttaggagcaaccacaacaaccacttccggagccatattagtaatggtgcaaccatttagccatcgatccttcttgaaaatcgtgttttgtccattaccaacgaagttcaccattgagatggcaaagaagtcacatgtttttttttctaaaacgcgcaggagaactgcgcattagatatattaagatagaagaaacaccaatggtctaaagaagaccagagtacagagaaacaacaaaaataaaaataaaataaaataaaaataaacatccatctagaagacagccaaagctgcccctaaactaaggccagatggtgcccagatctttggcacccgcgagacaccacctctaagcatcgtctttgatgttctgaataatctggttgccactaggaacatccccctcaaacatacatttattccgctgtttccaaagccaccatgccaccaacatcacaagggagttaatccctttgcgcagcgcataagggaccttatcctccaaattagcccaccaatcttggaaaaccaaatcagcccttgcgggggagaactgccgcagattaaccagggagaaaatcctaaaccacacttccctagagaagacacaagaaattaaaagtgatggaataagtcttgagcatctagaggacaacagtcgctttttactgtcctctgtagtcctttagcatctagaggacagcttgactgtcctctgtagtctctttagcatctagaggacagcagtcgctttttgactgtcctctgtagtcgctttagcatctagaggacaacagtcgcttttgactgtcctctatagtctctttagcatctagaggacaatcctgttgtgtagtgtgtgtgagaaggtgtggtagtgcagcctctagggctataaatatgggtctccaacccttagatgggtatggcattgtgtagtgtttgaggaaataaacagaaaattgcctcaactcatagtgtcatcctcttgatgagagttagagtccctctacttacaattggtatcagagccaaactatcctgcagcctaaacatctcgtgctcatctgcttcccgcgcctctccccacactcagtcggcagcaagagctccaactgttccttcctcccctgttcagacgagcagcctttcgtctgagacagcctcttccacacgcagcgacccctcactagcccaccatgtccctacactcggccacttcgagtgcgcggcgccagcaggaggccgaggtcgccgcggcacaagaacgcgatcgagcagcagcagcggctgcagcgacagcggtgagggcagcacggttggcggcggcggaactggcagcggcgagagcggaagtagaagcagcggaggcggcgaatgctgcacgtgcggcggcaacagagctcgaggttctgcgcggcagtagagctggcagctctgcttctgtcgacgacaacaccgacgaagagctcaggctggcgagggaagcagcgagagagcaggcggcacagtgggcagccgcgcatccccatgggggcgcgcgtggcggcatcccagataggcgccgacgcgctgacggcgctccaggcgagggcgcacgcggcggcagcccagacgggcgtagacgcgccggcggtgctcccggcggcggcgaccgagtcgacggagatcgcggcctctacaggcggcgcggttctccctccccggatcggtaccatggtcgccgcatggcccaggccattgtcagggacatcggtcccggcggtgggtggcgtaccctcaccaagaccaactacgtcgagtgggccgcggtgatgagggtacgactccaggttcgccacatgtgggaagcagttcgttacgacgacgtcgactaccacgaggatcggcgggcgctggatgccctcattgctgcagtcccgcccgagatgcagttttcgctttcccagaagcggactgccaaggaggcctgggacgccatcgctgcgacccgcatcggcaacgatcgtgcccgcaagaccacaccgcaggcacttcgcaaggagtgggagaacctggccttcaagccaggtgaggatgttgatgactttgctctccgcctcaacactctgttgcagaagatggtgcagttcggcgacgacacctacgatgaggagagagctgttgagaagctcttccgttgcatccccgagaagtacaggcagattgctcgctcgatcgagtctctgctagacctctccacgatgacgatcgaagaggcgattggtcgcctcaaggtggtcgacggcgacgaaccacaggctctctctgggcctatcactatcagcgggaagctacatctcactcgggagcagtgggaggcctgccagggtgacaagaagaagggggagtcctcctcgacacgaggccgcaaacgcggcaagccgcgcaaggcgcgtggaggcgcccaggccggggcgcgaggacatgctgagggtggtgcccgtggaggtgcccaaggcggcatcgtcggcaacaagaagccggcacgagacgacggctgtcacaactgcggcaagcttggccactgggccagggattgtcggcagccacgacgtggccaggccaacgtcgcacaggcggaggcggaggaggaggccctgctcctggcacatgcaagcatcgagccatctccagcggcaccgggccacagcggcactcctccaccttgatgagtcgaaagcacgcgctttcctcggcgacggctccaacaaggacatgatcgaaggatggtgcctcgacaccggggccactcatcacatgaccggccgacgggagttcttcaccgagcttgactctagcgtccgaggctccgtcaagtttggggatgcctccggcgtagagatcaagggcgccggctcagtcgtcttcaccgccgcgtctggtgagcacaggctgctcaccggagtctactacatccccgcgttaaggaactctatcatcagcttgggacagctggatgagaacggttcgcgcgtggaggtcgagcacggagtcatgaggatctgggatccctctcgtcgccttcttgccaaggtacgcaggagtccaaatcggctatacatcctcaatgtgaaggtggcacaaccttgctgccttgctgctcgtcgagacgacggggcatggcagtggcacgagcgcttcgggcaccttaacttcgaggccctgaagcggctcagtgccaaggagatggtacgaggcctgccgtgccttgaccatgtggagcaattctgcgatgtctgcgtgttgacaaagcagagacgactcccctttccccagcagtcgagcttccgagccaaggagaggctcgagctcgtgcatggggacttgtgtggcccggtgacaccagccacaccaggaggacgacgctacttcttgctgctcgtcgacgatctctcccgctatatgtgggtgatgatccttggcagcaagggagaggctgcgaatagggatgaaaacggtcgggaacggtcggaaaaatacctcatatttaacttgcgggacgaaaacgaaaacgggatatatcggtaacgaaaacgaacgggataaatacaggaatcgaaaaacgataggatccggtcggttaaacgtcgaaatcggacggaaaccggtatttttgttcggtaaaatcacatcatgaaaccatatattcaaaacttaacaaaaaattctagtgcacgcatagacttacacccaatgcttatttgctcacatctctaaataaacataagacacattgctcatggagaggagtcacttgctacatcttcgttattctaaaaaaattctagtgcgtcttcatcctattaatgcacaaaaaaagtcagctagaaaattctagtgcggcaccttcattattgtcaacatcctattagtgcgtcttcatcaatttagaaaattctagtgctgcatcttcattattctcaacatcgtattaatgtgtcttcatccctggaggcctggacggtggaggctagcagcccctagaggtctggacggcggaggcctggtcacctggacggcggaggttgggtgccgtgttgcctgctggtgcagtggtgcagcgaggagccgtcgacagcagagcagactctgcacgacggagggcagagggagaggtcagagggagagggacggcggacttgggagagggatgtgctgccctgctgggacggcggagggccggtgggccggaccgccggaggctgggacctggtactgggagaggaatgtgctgccgacctgtcctgctgggcgacgggcgtttggactttggagagagggcggcggcgtgtggagagcaggagggacggcgtgtggaggactggaggctgccaggcactaggttagctggttagatttgggcttagatgggctgagcctagtgctcccgaattacaaaatacggtaacaaaacgggatcatcccgattaaaaacgggatcctggttaaacggtcgggaaaacagctctaccgtttccgtttccgtttaccgttttgtatatcccgttttcgttccattttcgttttttacatcgggttcgaaatcgatcgggacaaaaataacaaaatcggttatacgataacggtcggttcgggattttcccatcctactttcatccctagctgcgaacaccatcaggcgtgtgtaggtcgctgcggaggcggagtgcggccgcaagctgcgcttgctgcgcaccgacaacggcggcgaattcacggcgtctgagttcgcgtcgtactgcgcggatgagggcgttcagcgccactactccgcgccgtacagcccgcagcagaacgacgtcgtcgagcggcgcaaccagacggttgtggggatggctcgggctctcctcaagcagagaggaatgccagctgtcttctggggagaggcggtggtgacagcggtttacatcctcaaccgctcgcccaccaaggctctcaacgggatgacaccgtacgaggcttggcatgggcgcaagccggcggtctctcacctacgggtcttcggctgcctcgcgttcaccaaggagcttggccacatcagcaagctcgacgataggagcaccccggggggtgttcattggctacgcggagggctcgaaggcctaccgcatccttgacccaagaacacagcgtgtgcgcacggcgcgcgatgtagtgttcgacgaagggcgaggatgggcgtgggacaaggcggtggacgacgacacgactccgacgtacgacttcaccatcgagtacgtctactttgagggagctgggggagtagacaactcttctccgagcaggtctaccccagcccccaagtctccaccgactccagcgccaaactctccagctcctgctacaacgagctcttcaccaccacgcactccagccacgactccggctacagcaagctcttcgccaccacgtactccagcaccgacggtaccctctccgggaacgtcctctttgacaccagctcgtgtcgaggacgacccagtggagctcgtgacccctctgtcccgcgacgaggagcgcgtcgatgcgtgctacgacgacgagccgttgcggtatcgaagggtggagggccttctcatcgacccgtcggtgccaggccctgcatctcgcattctggcaggagagttgcatcttgcatgcgacgatggtgagcctcggtctttcgcggaggccgagaaacatgcggcttggcgtgccgcgatgcagtcggagatggacgcggttgagacgaaccgcacctgggagctcgctgatctccctcatggtcatcgcgcgatcacccttaaatgtgtgttcaaactgaagagggatgaagccggcgccatcgtcaagcacaaggctcgcttggtggcacgcggtttcctatagcaggaggggatcgacttcgacgatgctttcgcccccgtggcacggatggaatccgtgcgactcctccttgcgctgtcagcccagcatggctggcacgttcatcacatggatgtcaagtcggcgtttcttaacggcgacttaaaggaggaggtctacgtacaccagccgccaggttttgcgatccctggcaaggagggcaaggtgttgcgcctgcgcaaggctctctatggcctgcgacaggcaccgagggcgtggaatgccaagctggattccacgctcaaaggaatgggtttcacgccaagcccgcacgaggcggccatctatcggcggggcaatggaggaagtgccctgctggtgggtgtctacgtcgacgacttggtgatcaccggcgccaaggatgcagaggtggcagcgttcaaggaagagatgaaggccaccttccaaatgagtgacctggggcatctctccttctacctggggattgaggtgcaccagggagactccgggatcacacttcgccagaccgcctacgccaagcgcattgttgagctggctgggctcaccgactgcaacctagctctcactccgatggaggagaggctgaagctgagtcgcgacagcacgacagaggaggtggatgctacacagtatcggcgtcttgtggggagccttcgctacctcgtccacacacgacctgacttggcatactccgtcggctacgttagtcggttcttgcagcgaccgacgacggagcatgagcaggctgtgaagaggatcatccgctatgttgcggggacactcgaccacggtctctactacccgaggtgccctggggaggcacaccttgtcgggtacagcgacagcgaccacaccggtgacatcgacactagcaagagcacaagcgggatcctcttcttcctcgacaagtgcctaattagctggcagtcggtcaagcagcaggtggtggccatgtccagctgcgaggccgagtacatagcggcgtccactgcttcgactcaggcgctctggctggctcgactgctcggtgatctcctcgggagagacactggagcggtggaactcagggtggacagccagtccgctctggcattggccaagaaccccgtgttccatgaacggagcaagcacatccggctgagataccacttcatccgagactgcttggtagaagggagcatcaaggcgcgttacatcaacaccaatgatcagcttgcagacctactcaccaagccccttgggaagatcaagtttgttgagctttgctccaggtccgggatgacccaactttctcacaagacgacgcccaagacttagggggagagtgatggaataagtcttgagcatctagaggacaacaatcgcttttgactgtcctctgtagtcctttagcatctagaggacaacttgactgtcctctgtagtctctttagcatctagaggacaactgtcgctttttgactgtcctctatagtcgctttagcatctagaggacaacagtcgcttttgactgtcctctgtagtctctttagcatctagaggacaatcctgttgtgtagtgtgtgtgagaaggtgtggtagtgcagcctctagggctataaatatgggtctccaacccttagatgggtatggcattgtgtagtgtttgaggaaataaacagaaaattgccccaactcatagtgtcatcctcttgatgagagttagagtccctctacttacaaaaagatgatgcaccgtttcatcctcttgatcacaaagggggcattgaacaggatggtccaaacccctcttcgccaaacgatctgcagtccagcacctatctcgagtcgcgagccaaagaaagaacttgtttttggacaggaaacttcaatccgttccggggttagaggggtctgttttttaaaccaaagccatctaagctgcaaggcccaatccatataacaaagattcgggacacctaagcctccaaggcttatgtcacacccggttttaagggcaaaaccgaatgcgtaacatatgtgtgccaagatctttttccacacatatgttgacatcataagtgtaatatatcaaaagaacaatgcataaaagcgtaaataaagattatattaacatattatacttcaaacagacataatgtcttaacctttattattcatcaaagtatagcagaacatggacatccttccacaagaagatgatcgggggtatcactagactagcatccatcgagttcaccatcaaaatcttcatctgcaaatttctgatcaaaattaagcaagagtgagctcacttatgttcggggctcagcaagtggggtgaaaatgcaaggttaacaaggtaaggctaaagtttaatgcggttagcattttagttggtcaacattttattatcaacacctaattactaagtataagtatataccaaacccaattaagaataattcataatcaacataagctcaaaccacttgagcaagtaccataaacataaagctcaacctcttgagcgaacctcttaagcatatcgcttaaacaaaaccgatcacgatttatttccatcttcaagtttaattatcatttgagggtccaggctgctattaccgtgagcacgactgatatatcagttttacactctgcagaggtggtacaactttacccacaagccgtgtatccccctctagcctgggtcagccaaacccgtaaacacttccaaggtgaatggttagggatccactatgaggtaaggtttccaagtcggagtggaggccctcttggcgaggtagcttagccaagactaggtctccatgttaacgtgagctgccaacatcaaccgctccccctcttgcccatatttcaggtaaggttgctaggcactaagcatataaagctaatcaccaaagccagagccatgatagcactcgtggttgcactgttttcctgggtggtcactccatgttccaattatcacaatatgatcttgcttaatcatcagattaacaacaataatgtaaacttaccatttggaacattaatatcatcagtaggagtaccagcttaaagttaaagttgtagcaatagcataaggaataaggttggaaaggttaggtgtatctgaataggtaacccatcaaattatgcacatatccaaaagtaatctttattgaatgtattgtatgagatcagacagaatatgcaggggagaagtccacttgccttgcttatagaaaactcgagattcttccacgaaatagatattgattgtcaactactggatcaatctctaaacatcacacaaacaaacaagaagaaacaaacaccactcaataacatacaccatttaccatagacaaagctaaaagcaagtataacgaaaggatcatttgctttcaaaaacaccacaagcaatgattataacataaggatgctctttttgaaaaaggtttgatttatatttataaaacaagacctaagcttgaaaatatcttaattacaaatatacaaatattaggtttaccattttaatcttttataaaagacatgtgtgttatgtctaagattaagggttcataagacgataaaacacattataataatattaaacctttttaaccttttagaaaagatatatgttatatatctaagattgatgagctacgaaacacattattaatttttgaagcattatggaacatattctaaaacatttatttataaagaactttaagatataagcctaaccatggtttatgtgaaaatgtgactaaaccaaatattatctttatatttttattaagaaacatatggtctacatattttttttaaatttctatttaaggcggctgtacttaaagatctataatgaacattgttaaattatgaaaacatgatattcattgaaaaggccaatttaatacttcttgtataacaaccataattcaaattcaactatgaaagtacatgaactattgaaaacactaattaaaatgcttatcgcataattaatgaaactaacaaaaccatttataatttatttaggttccaatatacatgttattaacaaaaactgtaataaggatcaaaacataattaaaggtagactaggaggggtagttaatacatttacactttttttatatagatgtcattatacataactatttctctttttttattataaaaacaagagaactaatcaaaggctattttaatatggttaccacataaattatggagttaacaaacctttattattttttatttggatttgacacatattttataattgaaatcaagtcgcatgaatttatacggtattaaccatatacactagtggtagcatataaaatttacttgtgttctaccttccgacagacgatgagcagagcggggaaagagcagggaacgagcgattgcgggctcgttgggcaagctcgagcgcagcgatgacgaacggtgacgacgtcatggcttcgcgaataatgctccggtgagggaatttcacgaacagcagggcgtcgtggcaaggagtctccgacgagtagcgcgtgcagcaaggagcaacaacaccgattagagacacggtgcggcgaacccggaacagggcaagctaggcgcaggggcggatctcctggcggtgacgacgacgtacttagtaaggcgcgagtagcagcttcagctggcgagggacgggtcgacggcgcgaggtcctgacgatgtgcacagggctccggcgagctgcgaagatggctggcgacgaatggcgcctggtgctggtgggatcgagattgggcaagtaaccgacacgacgacacactccagagaggggactcgtagacgtagaaggcttcggcgaacttggcacagcggtaggagtcaacagcgtcagcggcgagaacagatgatgacgcagtgcatgcaggcagctcgagcgagagaaggaacgggcgagtagagacatgaagggccgagcaggggtgaggcgaggtgagaagtgtgggcggaggtctgctcttataggcgaggggagggaggagaaattaatcggcgttgatggccaacgttgatggccattaatattggcattcaacgaacaaaaaacggctgcgggaatgggaaacaggtgaggcgtagcgagatgagcgcgactgcgggcgcatcgtagcgtgggtggcagtgacgcagcgcggtgcgggcaggttggatgcgcgggcgcagaggagagtgatcaagggaacatgagaagagttcgacgtgtccataaatagcccagggagaaggaatggcgacctcggaaacgtctgcacgaaccaaatactattaatgaccgccatcgagcagacgtgaatgcgggagggaaaacgacgacgcggtcagtgaggagaggaaacggacaggtgcgggcataaggctgctctactcgcggctagggcagggaggcgtagaggtggccgcgcagagccaaaagggtacgacagcagacgtcccgacggcggctgcgctgtccttgcgtgcgggtgaggagccggaagacgaccagtgctgggaggggtgagtggggtccacatgccaggaatgagggagggaggcgcgtggcgtgatgggcttgcatgtgctggacgtgcgtgagcatgattttttttatttttttttagtttccatttccaaaatatacatacatacatacatacatacatacatatatattccaaaattaggataaactcaagtttattatgaacaaatcaaaatacatacttaccaaatttattattttaataattcattattatttgaacaaatgagattctcttcacaagattaattccaaaaattggattcaaaattcacatcaatcaaaacacatgtttcagaatgaatgcatcaaacacttgataaattttattgctaaaaaattacttatctttgtttatatgactatgttattatttgaaaacataaatgttttcctttccactgaaaattaataatataaactaagttatctttaattgatggatttagggtgtcacagcttaaaggcctagacaccttatcccaagccaccaaacaactacctccattgaccccctttctttctaaaggaatgcccttcagactctttgatcacccaattgggaacattcaaagcaattaacaggtataccgaaatggttgataaaacagatctaactagggttgttcatccagtaagattaagagtagccttctagctaggaagtctatcaacaattttctccacctagtccaagaggttcgatctccttagcttcaggtttgagatggggagcccaagatagaaagtcacaacccttttcatggatgtctagtgcctagcctagtggtcgtttggtttattccttaattgggcctttctttttttttgtttctggccaccttgaaatggtcggctcactttggacctggtactactgcttctacttaatataatgatgcgtagttctcttgcgcatttgagaaaaaattgagaactgttaggaggatgaaaccctaaccctaactaggttaactagggttgagctgctatattaatagatgaaatagtatataagtgggcctaagcctgttacagttaaggcacacacatgtctaacacccccgtagtcgcaactctaggcattacaaatgttgagattggatcaaaactccgagaacaccgtagacttgtagaggggagccccttggtgaagatgttggcgaactgcgaagtggtcggtacgtggaggacgcgtacatcgtcaatgacgacacgctcatggacaaagtggaggttgatctctacatgctgcacggggttggtggagaggtgtaccacgttgacattttttatcgaaaaaactgtgggggaggttcccataatgaaattttaatcaaaagagataaaaagatacttatagctaacaacttagcaatattcaccacgatctcccaccagaaaggagagagaaccgaaataaaaaagaaaagaaatgaagatccgataagcgagatctcaaaaataagattacatgttgtctagccatgatagaaaggtgggttgataaatttctctaaatcttggactttgtagacgagcttcttttttaaaacatagagcccagaggctgagggagtcttcattgctgtaaaaaatctttctgtttctcattttccatagctcccataaggtcaaaagaagtagaaatatactgcatgtctgcactaaccgttggtgaataaaaagcctaacatcgcatcggatattaagaagcctccaacatcgagttacgaagccgcaggtaaaaaaagatgatcaatgtcctcatcctcatcccgacacataacacaatgggaattatgttcttgcagcagatttttcctgagcaacataacgctggtattaagtctgttcatgagcagtagccaaccgaaaaacttgattatcattctacatttgcacttccaaaactttgagaataccctagaaacctgggaaagtgggaagtcttatgtttgattttgtagtatttcctgacaaagaactttgttataccattattcgaaatccaaatatccttttgggcatctagcaaccacaacacgagtggtaaggtctcgtatggtgagcccccagggaccgaactccacagaatagtggttgttagtggtgaagcaacgaatcaagagaaggttctagatgatgttgtatggtgagcccccagggaccgaactccatagaatagtggttgttagtggtgaagcaacgaatcgagagaaggttctagatgatgttggggggcaacaaggatgttgttgatatacaatggactaggaagaaccgtgtcacctactaactactaaggtaacaaacatagtcgacccattatcgataatgatggaagaagttaaagtggggataggggaatgaggtaaagaaacaatattgtggtcaggagtggtgtggtatgaggcgtcgaagtcagcaacccaattggtgggagtaggagtgggcggcgatgacattgggggaatgaggagagaggtaccagaggcacccccacagagcaaccgggaggggcgctggggcctcctatggcgagcatgatgacaccgaacatgggttgtgaagacaatcgcggaactgcgaaacactaacaacccagtagcgtggtggccctcttgagggtgggtggaggctggagggtggtgaagctcgatgtagtcatggaacacagggttcatgacccgatcaaagaccacaaaggtgcctcggagaagctggctgtcgtgaagggagacgcgcacacaatagggaggcatgtggattctggcatggcgaaggacgggcgtcaacagagcaggtgcgagagcggacatgtcgctgccaggaaagtgccctacgcgtgtgccggggtggggttagggaaaccgaagtttaacagtgctggggaaaccgttgggcacaacgggcgtcactgcggtcgcgaggagcagtggaggccgacaattgttggggagaggccaaccaccaagccgggcgtcgtgaagaagctggggagcatcgccgcaatcgaaggaggacatagggtgctgcgggtgccacgactgcagctaggataacgtttgaccgcaccggcgaagcagggagcaacgtcgcctgagaagaggtgagtgactgcgcgtgtggcgctgcaggcgtagggaaggaagcggacaccgaacaaacctgatgagggcgtcgcgaccgatgcagaggtataaaggaccgacgtggagctgctgatggccagagtggagatgtagggacttcccatgactagggaacaccgtcgagtgggtcagcgtggttgctggtggacggagtgtgggcgcaaggtgggaggcagcgtggtgagcgaggagatggatgtgggcttgctgtcatgaagagacgacggagaagacgacagtggccgtcgagaccaggggtcctgactaagggaggtggaaagaaggctggaagacgaggtaggcacggagcggtgtgaagggtccaggagccgcacgcgggatcgacaccaagacgcagagatgaggcatgagttcgacgaggaaggggatgaggaggcgtgtccgagccattgttgaagctggtggcgtcgatcgaggagttggtcgtcgtcggagaagagacctaggggagccgccgtaggcaggggatgaggtggcgcgcaggcgaagtagggcaggggaggagcgcgcacaactgtgcggtggtggagagatggcccccctgcgtagcagggggtcgtcggtcgcccgcgcagcaagggaggtgagaggcgtgcagagtgaaggggaggtagtggcagcgcgaccacaggtgtccgcgacggctggggaagggtccacgacggctgggagagtggaggcgcaagctgttcaggcatcagcggcggcggcagccgcaactatgtctggcagaagaggcttgccgacgggagggggtcgctggcggggagggtagaagaccggcagttaggggagggagaaggcaggaaagaggaggctctataccatgttggggagtgaaaccccaaactctaattgtgtaggggacatattatatgtctaggaatgtgggctaaggcccattacaatatacatgacacactaacactcaggtcttgggttcgactccctatggaagcgaatttcaggctgtggataaaaaaacctctagttgtcccacgccaaagcaaaggtctaaagcccggccccagtcgtggtcgttctcacatgggctacggtgccgttgtgtatgggtggggtaggggttcaggatttttctcgacttgtgtgagaatgtcttcttaatataataccatgggggcaatcttacccccacaggtcaagttgtttttatatgaggaattccaaaaaaaataaagtacaaaaaaactagagaccaatttcaacactttaagcaaatatttccatttatgctgacactctaagatttcttgtgaattgtgggtaaattttcagattaattgtctacgtgtgtaggttcttgggaaagcccttggaatacccgagaacagtgtcagaacatacactgaggctgaaattcgtgctaggtaatgttttctttggagcaacataagagcactgagtgttcctgcacattgtttggacgatactgatattaagattaacatcaatctgattcatgtgaatctaactatttagatttgttttagtgttatttttcaggtctcgaaactttgcactgtacttttaaaagcaactcgagcagttcttgggtcgtctgtgtgggatgttcttgttcctggagtggcccatggagccttgatacaggtgtgggcaacttctattcgctccttttgccctattgttgtgttcttaccaatgatttcaagtcgtccgactaatcgcgattagtcgggctggtcagcaattaggacacgatttgctggacgactcgactagaagacctagtcgtccgactaatcgtcgactagggcgactagtcgtttgagttatgtgtcctagtcgtcccggctagggtttggttattgggcctttttagcccatctacagtctaatttagagtaccctctcttctcctattctaacctagccgccaacagtctccaacttgcacgtttcttctctcctctcttggcaccgcccctccagtcctggactgctgattgtcggcggctacaccggcggccacaacaccctgcgtcccctgccccttctcctgtatcctgctcacctgctgcactgttgtagtctccaaccggcggtggctgcgaaccagtgacgagatgagcatgtcatctgaaggtccctcctgctcccccacttctcccccttctctgtactccattgggatgtcacatgtcacatgtcaggttcaggtaagtcacaaatcacaatgaaacaatatgttactttgttatcctagttgtttgttctaacttatatgatgtatacatgtatatttatatatatacctatataagtataactactagtctaggacgaccagggaccgactaggaccgactaggggtcgactagtcgtcctagtcgtcgcctaatcgtgactagtcgcctggtcggtcccagggttcgaccaggcgactaggcgacttgaaatcattggttcttactataatcaatgtaagttttttttgtgaatcccacaccatgcccacaaaagaaaaatgacaatttgcccttcattttttaatgagatgtaattcaaaacatgttgcaatatgacaagatcaaacatatttatcattcaaatgatcagcttatatactgaatagttgtcaaacacacatgatgggtttatgcatgccttaagcttcatcaaatgattaaaaagaggcaaagagctaaaatttagatttgatgataattcataataattcatttatgtaaatcgttgtagaaaactgaagcatataccataaggcaggtttctgtcatactaggatatttgatgttatcattatttcagttatgattcatgagtggcgttgaccatgatcctttaaaaattctggcctactcttgagtcttcaaaaaattagaccgtgtaggatgagacatctcctgagcattttaattagaacaaaccctagacccttactagggatggcagtggggtgggttcggggcgagtgcaacttctgcggacccgaacccgaaacctaaactaaaaacccgaccagcacccgaaccccatggcggggggaaatttgtccccgcacctaaaccagatggggacccgaaaaccgagacatgcaaactcacttaacacaaacaccatttaattcaatgctccaccacgagaacagacgtctcacctcggggcgaagctcggagtggcttggcgcggcttccgacgggctgggtggccggcacggcgggcgcaggtctctggcgagcgcgagcggcgagagcggagcgagagagagagtgggcttgcgcggaatgagacaggggagcgagtgcgggtgcgggcggtgctcaaaaggaagctggggtgcgtgggcaggcgacgtgggtggggatctcggcgtgcatgcgcgctggtccacggcggttcgcggggaaggcggagctgatagggcggccccacgacgcagagagagagcgggcgtgcggagaaacggttcatcgtgctgacaggacgggcccgcgaggcagagagggaaaagggcgcgagagcgagggcgactggtgccgacagaccggccccactgggcagagggagaggggaagggagcgcgcgcggagagaaacaaccgcggagacaaaccagtcaggcgacgctggcgcgcgacctggctgggccgagctgggccggctgggttgaattggtttttctctttttctggaatttctaatgccttttctattttattttctctagggttttcaattcaaattcaaaccaagtttcaaattcaaagcaaatcaaacatgtgcatcaattcaaagaatattttggactcagcatgatgcaacaattcatgacttacattgttttaacaaaataaataattaactcctctcctaattaacctaattctagccaaaagaaagagagagagagagagacaagagtaacacctgaatttggtagatatttagaaagaaattttatacccccaaattcggggtgttacagtgtccatggctgttgctgcccctatctttgtcggcgttgcagaacgacatcaaccctcgtgtgctccacttcctcctcctagtgtactatcgtccgcccctgcctccgccacctgcgttggtgtggcgccatgcttggttgcgccaaacccaatctccactcctggcacaccaccgcccacccttgcctcctctgctgctagcgtgatgccccacctaaccgcgccgccgccgctggtcacgtcgccgctcgcccctatcctagtctccctgatgccggcgctggtgcatggaccagtctcccccgccatcatccctgatgcctcgtcggtgtctcgtcggtctctaacgcgctgggtggtctaagcctcactagttttggcatcctaggcctcgtcaactttggcactgccgctggtgccctaggcgtgggcggcctaactcctgttggtctcggctctgctgccttggctgttgttggcatgcgcgtcccaacccttgccgtttctggattggtcctaggcaaccctggcacatgggtccccttccatctgccctcccgattatggctccactactgctaatctttccgatcacgagacgactggtcctcctccccacgacattgttgctgctcattctacgctcgccgctggcctcgcggtcgctaatgagcgagtcgtgaacctcacttgggagcaagaaggtactactgtgtatgcccttgttcttcaacttgtggaggacgagcaccatttcggtggtccttatatcaatccaccccagctttctcgatagttgagaccgtgtcggcattcgaggctttcgtccccatgcccaagcgatggtgtcctctatgcactaatgaggttgctaatcgcaagatgaacacttctctaatctcctcactatacaaagggttatcttatctcttagaaggttgccatatttgttggaggggacaaaacatcatgtggacctgatatgagggtttgtatatagcctcaaagggccaaactagctgttataaatgcactcagaaatttcgtgtgcaccagatgtgtccgatgcaaaatttcagagcacagaacaccccgatgccactccaatgactagttctaaaactacttgtactgtgccagatatctggtgtcagcaccagtgtcacactggagtcagtatcactggattctaacatgctctctaagtaccctatctagggccacatctggtggcacacaactacacaaggcacattcggtgagtactcgactgttgtgcacattttgcaggctttctgggtgccttgttcggtgtggtatctggtgccacaccggacacaacagtgagtacaaacgtgaaactactatttagaagctctctgagtgccatatctggtgtggcatctagtgccacatgggatacgctagtgatttcaaatatgtttcagcacaatttgcaaccttactgggtgcttggtgcttgttcaatgttgttcatccggtgcacactgatcgtgccagtgcaacttagatttagcacaaggccaaactcgtatccaatgcagcatctggtggagtaccaaacattttcagtgctactgcagactctgtgaaacatggtttttgtttgttatttgatttggtttttcctccaaaatttttgtgggttctcttgggttatctagcactagttttatgcaattgtattgtacatcaccacacctaactaaacttgactatgtcaagttacccaactcatgcccttttttttctcgaaagcgtaggagaatctcatgcccctctttacagtacaactaaaagaaaatagaagttctatcactaatctaagtgtccaacatctccattgatacctagaactgagaaatttcattatttgggtttcaattcgtctgcctgagttctttagggactcaattcgcttgccttttgttatttggcactcaggcactccaacttttctgtctaggtctttcttggacgtttattgattttgattcattttatcgtgtacgcattccttggggataacctcatctcctggaccttcaagcgtcagcccatggtcccccgctacagcgtcgaagttgagtaccacaccatccccaatggtgttgttgaggtgtgttggctccgtcagctcctaaggagcttcacaacccacttaccaggagcatactcatctattgcgacaacatcagaatcgtctacctctccatcaacccagtccaaaacccacacacaaagcatgttgatatggatcttcatttcgtctgtgagcctgtggcggtcgaggacgttcgtgtcctccacatcctgatgacctcacagtttgctgacatcttcaccatgggattttccatccttggtgttctcggagttttggtacaatctcaatatctgtcgtggctagagttttgactatgggagccttagactgtgtattagccatgtgtggctgggagtgttatgggactagggcccaacccatgtatatcctgttagggttaggggaaaccctagataggtttatatacattgtaaacattaccatctattgggttatttgtaaacattatcaggttgaaagaatagctcctggatcattgccgtcatccatgaaagaacctgtcgtgctagttgtaaacaaggcagatggagatgaagaggtatctataaacaattaaattcttggtttgttattcttgtcttgataacttcatgatatcacaaagccttggctcctcatttgacaggtcaaagctgctggggataacatagtgggcgttgttcttctacaagaattacctcacctatcacatcttggtgttagagctcgtcaagttcgtaccaaaagcctcattttatttaaatactgtttcgtttttaatgaattccactgcatttttttggaaaagaaaaaaagaatgctacttacatatgtttccaggagaaagttgtatttgtaacttgtgaagacgatgacacgattaaaaacatgaggttacttgagggaaaacatgtcaggttaggttctattttactaacatttcattccattctgatatggactgtgttggctcgcatgtcctgaaaaaacattaaatgaacatatttatttatggccactgtatgagaaaaaaacaggaaagatggccccctcatagtaaacctgactgctaattaagcaccacttagtggtattgtagtagcatgctactcctatgcaccctctacgtgaatttatttagtgagtttttgtgtttctttttcaggttgggtgcatcatccaataatgttgatctttcagttgtatcaaacaaagatgactgtgctgccatgtcttcagagccatccgctggaggagatctatttgcacagcaattctcactattgactacagacaagaagttagaattgtctgaggttaactttcttttgcctcaaatcatgtaatcaaagcatgccaatccaccacatcttgctaactacatgttacaacacatgtttttatacttgctcctactttttttcttttccctaactctaagggaccttcacttcagcaaaagagctatacttccgtagcaaatggtatgtctggtgtgctcgagctttcagaggcatcgattgaatcatctggtgcaaaagctgctgcatgtggaactctttcggttctttcctcaatgtcaaataaaggtaccgattccagttgtaatatccatcaaattcatgtcgatttgtgttacctactgtgttgtgaatcaaggtagttatcatttatacaaccagttaatttgcctggatgttattagtatgttgctggttattaacagagaagtattaaacagggcagataacttgcattccacccatccatatttgtagaatatatgcaccgatggtatcattcaaagcatgtaaatctagctcataatgctgtacactcctttaatgaataacaaatgattaaatatagtgtttaaccaaggtgatcaagaataagcctagttttcatgtaacaataactaagaacgttgtgatagctttttatgtgctagaatggaaaaaaaaaagatactgttaaggtcgtttttgtagattgtggcacaaatctagcctagttcctggcgtgtggtgtgtctatgttcgttctacttgggtttgggttctactagactcttgtactacatttttctacgttaataaaatgacgcgcagctctcctgcatagttcgagaataaaaggtcgtttctgctgtatgattgtgtttatggatccatagaccttgtacattatgtacattaagataagaaaaaacttatatgagtacaacagaactgcaagcttatagtagtacggtagaactgctttcttgaaaatcttatgtttcatttcctattatcttacatttttcattgattattgggcagtttacaatgaccaaggaactccagcagcattcagagttcctgcaggtgctgtgattccttttggatccatggaggacgccttgaagaaaagtggatcactcaaatcctacactaatcttctagagaggatcgaaacagctcaaattgaaaatggtgaacttgatagcctatcctcgaagcttcaagcaactgtttcacttctttctccatcggaagaaatcattgaatctttgaagaaaacatttgatcagaatgttcgactaattgtgagatctactgctaatgtggaggatttggctggaatgtctgctgctggactctatgaatcaattcctaatgtcagtctctctgaccctagatcctttggagctgcggttggacaggtttgggcatcattatacacaaggagagcaatccttagccgtcgagcagccggtgtacctcagagagacgcaaagatggcggttctcgtgcaggaaatgctgcagccagatctctcttttgtgcttcatacaattagcccagttgaccatgatcccaaattagtagaggctgaggttgcccctggtcttggagaaaccctcgcttctggtacccgtggcactccatggagactctcatgtcacaagcttgatggcaaagtcacaactctagcttttgcgaatttcagtgaagagcttatggtgctcaactctggccctaccgatggtgaaatgagtcgtaggaccgtagactacagcaagaagccgttatctgttgatgcaacctttagggagcagtttggtcagcgccttgccgccattggacagtatctggaacagaagtttggaagtgcccaagatgtggaaggttgcctggttggccccgatatatttatagttcagagcaggccacaaccacaataa

SEQ ID NO: 22 - DNA, 3000 bp, Sorghum bicolor
  5'UTR (1)..(3000): SbPWD 5 'UTR and promoter
cgccgataccgatcttcacgctgttgccagctctcccgatgccttctatgtgtaatcacaatgccagattggggagaccttcctgagttggttccttcctggatcaagcccttgcctttggcatcatcggcagtaatttggtgttgaggatccaccgatgcgcttctttcagtcgcctctgatgtcaagaccttaatctttcccttagcatccaacatttttgtaggaaaaggatgttggtcaattttcattggcttttgagctttggagctgtcaaacttaattctcctagactctatagccgattgcagctgctgcctgaaaaccttgcactcatttgtactatgagatgttgcattatgccacttgcagtacttcatcttttttaattcttctgccgatgggattacatggttgggtgacaactttatctgcccctcctgaagcagaaagtcaaatatcctatcagctttggtaatatcaaatgcaaacttttctggttctttatgcccaaaggggcaagacatcggcttcttattcttgacccattctgccaagccgatgactggttcttcatcagagtctgagcttgttgcgtcatcgacaaatgacacctttttgttccatgccctcttaggttcaaaagccttaatatcttggtccgaaatcgtctgtaccaagtggctcagactttcgaactcctgagaagcatacttgtctctgatatgtggtaataatccctggaaagccaaatcggctagctgccgatcatctagaaccagactatagcatttattcttgacatctcgcaatctttgcacaaagctttcaactgattcatcattgcgttgcttgagtctaactaaatcggtaatcttcttctcatgaactccagaaaagaactatttgtggaactgtttttctagatcggcccatgtgatcactgagtttggaggtaatgaaataaaccaagtaaaggctgatctggataaagatgatgagaataagcgcactcttaattcatctctgttagcagcttccccacactggataatgaatctgttaacatgctccatagttgacgtatcatcctgcccagaaaacttggtaaaatccagcaccttgtaccgatttagaagtggaattaagttatatgcaggaagatacggtgtccgataagagtaagtgttgactttgggttttatcccaaattggtccctcataacctcagctatcttatcggcccaataagcatcggcatcttgccgatggactggctgtggatctggcacctgctgataagcttccacgtgtctctgtggcgcgcgatctccagggaacactggattagccattgcctattgacctccaatttgctgaccaagattcatcggctggttgatcaatccttgattctgaaatccatgctgcattgctccctgttgaaatcccgtagcctgacaattctgctgaggtatctgtggaaagacaaactgccatgtccatccattattaacgttcatcggcgtaggtcctaccgatggttgataattaggcatcatcattggattgacatacccgggctgtgtcataaacctctgttgcgtcggcatgggatctgccgatgcattaggcatctggaacgttggtacttgagaattcccagtgaaaggtcttgcagtagtagtcgtggaatactggggattttgtgtcatcggcgatactggggtgccgatgccataggagccttacctgtcacatcagtcatctgagatgttccaggactttttgccatcaattctgggggcataccatatccccaccaattaggaggaacagaccctgacattgccgatgctaacaaatctgtagcaagtttaacttgcccctctgatgttgatggattggtcgtcatcggtgtagattgcgcattagtcatccctaatgtgcttgaaggagacgtaacttctgataccgcaacttctcttcaagtattagatcctattcttttgccatggttgtatcgccacatgggccataaatctcgagagctcaagatcgatggcacagaaaaataggtacggaacctatacttggccaaacgggcggcccggccctgacactatatggcactatgcggcactatgtctatcgtgccgtgccgtgccgtttcgggccatcgtgccaaactctcggcccagatacgacactatggctccttaaccgtgccgtggcgtgccgatagacacggtggcccatcgtgtccgtggcttcgagagaagtcgagaagctcactgcgccctgccttaagaagaagacgagcatcaccgctgtcgtatagtcaggcgggagaaagagtggccgccgccctgccttaagaagaagacgagcatcaccgctgtcgtatagtcaggcgggagaaagagtggccgcagcaaggatgcgtctgcgccgccgactagggagttagggtttagaagggttgtgtgatgtttatatacatggctcagaatacattcaatggtcatgatctatcctaaaagcattagacgatagaaataatcatatcagcgtcgtgccagcctattaaccggtgcccgtgccagcactgcgggccgaagttatgacccaggcatggcactaccaccgagccgtgtcgtatctagaccgtgctttttagtgtcgtgctcaagccggtctacagtgttggtgccagataaaaatctatacggaaacccacctcttttgccatattttgcccaagatcgatgacttcgggagttgtcttcaagtttacactttccccccacttttcacccctaaaaacaggtacggaaaccacgtccacacgttccgctgccatcaccgtccttctcgcgccgcggcccgccctgccccgccccgaggccactgcctcctactctctctctcgcgctctctctctcaaagtcggaggcgacacccacctgttcgttggattgcggccgaggaggaagactg

SEQ ID NO: 23 - DNA, 2000 bp, Sorghum bicolor
  3'UTR (1)..(2000): SbPWD gene 3' UTR
acaaaaagttctgctaagatgaatgtggttacctggttagctgaataaaaatggatactggctgaagaaatttaaggactctgtagcatgaatagcagtgattgagtctttttatatgttatcttaggaaaaataataatttggcacaggttcagccattcacttgtatcgattttgtgaactaaaaaacttactggatatacataatgaaaatctacaggacttataagagtatcttcagtaatactactcaaaacagatacctacttgtatgtttaggtagtcatgtattttgatactacctatttttttgcttccaactctagcaatattacctaattatggctctcaaatttatttaagcagtcaatgacatgtgggactcatatgtcatcctctcccttcaaacagattggatatagatgggtatcactaatattgttttttttcatatttctattcatactcggattcaaatatagatagtattagctatgtcagatataatacaaatggacatcgacaatataaatatatgatttgagtattcagatacggtttcgaatgttgaatattcagatttggatatgggcacgtctaaactcttctaaacggattcaaactcggatatggtaggtggtgccgatgagggggttgtcggaggagtaccacccctttgtggggagggggtcaccgtgagaggcgccactgcggatctggcgtggacgtggctggatttggtgtggaggtagggaaggtcagcggtgggctccttgcatgcggcggtgtggaggcggggacgaaggtggatagtgggctcttttttttcaaattaggcggatagtgggctccatgcgagcgtccgcgtctaacgagaacgagcatgagacaacatgcgggggtggaaaaaacaaaggaaaaaatttgggtagccacccataggaatggatggggggatttggaggtcaacaaatttgagaggcctagtagacctagtaggtagtctgttagagtatgttttgatctccgttactaaaaatatgataggtagtttgttgaagactacattagcttatagtcacaatcacgtaagcggacgcccatggaaaactacttcaatttaatgaaatcatactttggtatgtgatttggtgaccacatgcttttatcaatttgaaagttaaaaactcattgtcacgtattcaaattgaattcacaaaatttgaatctaaaatggagttgtggaagtagacattgctaaaataattgattttgaatgcgcaagcttctttaaaatgagatcaactcttagatatcagagaatcatatgttatacagtttatttttttaagtgctaaaatttgtgttacatgaatcttcgcctttcaattatgatggactaatgtttacatttctaaatttcaagtttaaaacaacagcttactccaattcttgctacataacatctcacaacaaccacaatttgattcaaattatttgcatccacaaagttttaggttaagactataataatttatgttcacaaactaaaaactaaagagagtaccaagatataaactaggaacttacacaaaatcgatagagcaacaatgcatcatttttatagcaagggatttttttgacaacttataacaagggattcgaccaatccatgtgtacaaagctgggaatcatttttaagttatctcttttttaaatatgtaagtgaactaaaggaaaaaacttaaaggtccttttctaaaaaaacttaaatagtttggcgtggtaaaacaaaatgggtaccaagaataattggcaatggaaaggtagtctgtgacacgtatcgtttttatgacgaggggttcgaccaatcattgtgtacaaagttgggaataacttttttagttatctctttttaaatagaatcaatctagccaacaactcgttgttttatgtaattgaactaaaggaaaaaaaataaataatctggcttggaagaa

SEQ ID NO: 24 - DNA, 2000 bp, Zea mays
  3'UTR (1)..(2000): ZmPWD gene 3' UTR
acaaaaagttttgtgtggttacctggctagctgaataaaaatggatactggctgaagaaatatatggacttcgtagcacgcgtagcagtgatcgagtcttttttaatatgctatctcaggtaaaataataatttattggcacaggtttagccattcactaacttgtatcaattttgtgaactaaagaacttactattacatgtgggagccacatgctattctatttcgatggtacctattttttcgactgtttgaaaatctatatgacgtataggcctgtttgttttagcttcttggccgcttctgcccaccagaattggattctcgtaaacaaccgcccggcggccgaagcgattgtgggggagcagcctttcaaccgcagccgagaagcggctaagaggccgtggccgatggaagcggaaaggattcttcggagaacgttagtttgtgttcggtttgatttttgaccttggcttttttcccttaaaagctactaaaagccaaactaatataaaccagctttttatttttttataaaggaagctttattaaattttcaagttcatatatcaaggttatataaagtctgaaaaaacactttataaaactgaaagcatttagaaagcagcttttctaaaagccgactttctcacggtgtaaaactaaaagcaccttaggatctgtttttagtggttttaggatagaactatgaaatatatatgaaataatttttaatgatttttagtggttttcaccaaacgattttttgttttttaacagttcacagccacaacagttattttcatagctaatagtccaaattagctttttcacggtcacaacctaactaaacacacgatgagtttccatggcctgtagaaggagaaaggattctttggagaacatgagagtcaaagaagcttccactttttttgtgtaaagtcaggaccgtggtcgtctgactctttcaataaaaaggaatagccaaatctatcgagctggctggtcaatcccagtgatcttatcagccagcaaagtggagccagacgaccacagtcccgactttaccagaaccgtaggtttactgatcaatgaattcaaaagcatcaaacctctcgttttcgaaagaatcgaaacacattgaaatggtactaggcgtacttaaaaatagaaggatttggtaaaattgtccctcctaaaaaatattctagaataaatgggcattagttaggagaggtgcccgacggcaagaagcaatgttattagatacagaaggaaagcttggctagaaccgcacgtgcaagtctgtgataacttcttcaggtttgtgtgaactagtggatcgatcactaagtggttagtacctccagcatgagcaaaccttttttgaactgattaggaatgggcgccactatcctagctcggatctagccgagttctattgatcatgtctacatcccaactaaaaatcctttatcctctccctaatcctccattcctgaaaggaagaacgtggcattctttttttttctttctgcagggaccaggatattggatctagccataagaggaatgcttggtataaataagccacttcttggtttcgaccccttaagtcactacgagcgcccccgatcagtttaatgcgatgtgactatttatctatctcttgactcgaaatgagagtagagcaggtttgataaaggatcttagattgtctagggttaggttaggttcaaatctaggtgtcggttgactcatcttggactaacttgtgtactaagtgtatgaatacatgttcactaaatgcaatttgaagatgcttaagtccaaatgagctcaaaagaggccaggaattgcaactttgtgtaaaagggtaaaactgtgaggtttgaacccttaggtatgttacatatggatattacaatgtttctagtacttgtgtttgcactctaactcattttgtagagaaaagtgttttttggacttagtttgggcaa

SEQ ID NO: 25 - protein, 373 aa, Zea mays
  MISC_FEATURE (1)..(373): ZmDSP protein
MNCLQNLLKEPPIVGSRSMRRPSPLNLAMVRGGSRRSNTVKTLQAPGASTSGAESSAVEMGTEKSEVYSTNMTQAMGAALTYRHELGMNYNFIRPDLIVGSCLQSPLDVDKLRKIGVKTVFCLQQDSDLEYFGVDIRAIQDYSLQFKDIVHCRAEIRDFDAFDLRLRLPAVVSKLHKLINCNGGVTYIHCTAGLGRAPAVALAYMFWILGYSLNEGHRLLQSKRACFPKLEAIKLATADILTGLSKNTITLKWEADGSSSVEISGLDIGWGQRIPLTYDEEKGAWFLEKELPEGRYEYKYVVDGKWLCNEHELITKPNADGHVNNYVQVSRDGTSDEEKELRERLTGPDPDLTDQERLMIREYLEQYADAAER

SEQ ID NO: 26 - protein, 373 aa, Sorghum bicolor
  MISC_FEATURE (1)..(373): SbDSP protein
MNCLQNLLKEPPIVGSRSMRRPSPLNLAMVRGGSRRSNTVKTLQAPGASTSGAESSAVEMGTEKSEVYSTNMTHAMGAALTYRHELGMNYNFIRPDLIVGSCLQSPLDVDKLRKIGVKTVFCLQQDSDLEYFGVDIGAIQDYSLQFKDIMHCRAEIRDFDAFDLRLRLPAVVSKLHKLVNCNGGVTYIHCTAGLGRAPAVALAYMFWILGYSLNEGHQLLQSKRACFPKLEAIKLATADILTGLSKNTITLKWEDDGSSSVEISGLDIGWGQRIPLTYDEERGAWFLEKELPEGRYEYKYIVDGKWLCNEHEMLTKPNADGHVNNYVQVSRDGTSDEEKELRERLTGPDPVLTDEERLMIREYLEQYADAGER

SEQ ID NO: 27 - protein, 379 aa, Arabidopsis thaliana
  MISC_FEATURE (1)..(379): AtDSP protein
MNCLQNLPRCSVSPLLGFGCIQRDHSSSSSSLKMLISPPIKANDPKSRLVLHAVSESKSSSEMSGVAKDEEKSDEYSQDMTQAMGAVLTYRHELGMNYNFIRPDLIVGSCLQTPEDVDKLRKIGVKTIFCLQQDPDLEYFGVDISSIQAYAKKYSDIQHIRCEIRDFDAFDLRMRLPAVVGTLYKAVKRNGGVTYVHCTAGMGRAPAVALTYMFWVQGYKLMEAHKLLMSKRSCFPKLDAIRNATIDILTGLKRKTVTLTLKDKGFSRVEISGLDIGWGQRIPLTLDKGTGFWILKRELPEGQFEYKYIIDGEWTHNEAEPFIGPNKDGHTNNYAKVVDDPTSVDGTTRERLSSEDPELLEEERSKLIQFLETCSEAEV

SEQ ID NO: 28 - protein, 368 aa, Oryza sativa
  MISC_FEATURE (1)..(368): OsDSP protein
MNCLQNLLKEPPIVGSRSMRRPSPLNLTMVRGGSRRSNTVKTASGASTSSAESGAVEAGTEKSDTYSTNMTQAMGAVLTYRHELGMNYNFIRPDLIVGSCLQSPLDVDKLRDIGVKTVFCLQQDPDLEYFGVDICAIQEYCLQCKDIEHCRAEIRDFDAFDLRLRLPAVISKLHKLVNHNGGVTYIHCTAGLGRAPAVTLAYMFWILGYSLNEGHQLLQSKRACFPKLEAIKLATADILTGLSKNSITLKWESDSCSSVEISGLDVGWGQIIPLTYNKEKRAWYLERELPEGRYEYKYIVDGKWVCNDNEKKTKANADGHVNNYVQVSRDGTSDEERELRERLTGQNPDLTKEERLMIREYLEQYVER

SEQ ID NO: 29 - DNA, 1122 bp, Zea mays
  misc_feature (1)..(1122): ZmDSP coding sequence
atgaactgcctccagaacctgctcaaggagcctccaatcgtggggtccaggtcgatgaggcggccctctccgctgaatctggcgatggtccgcggcggcagtcgccgatcaaacaccgtcaaaactttgcaggcccctggggcgtccacttccggtgccgagagcagcgccgtggagatgggcaccgagaagtccgaagtgtacagcactaacatgacgcaggctatgggagcagcgttgacatatagacatgaactcgggatgaactacaatttcatacgcccagacttgattgtaggatcctgcttacagagtccacttgatgttgataagcttcggaagattggtgtcaaaactgtattctgcttgcagcaagattcagatcttgaatattttggagtcgacatccgtgccattcaagattattctctacaattcaaagatattgtgcactgccgtgcggaaattagggattttgatgcttttgatttgcgattgaggcttcctgctgtggttagcaaattgcacaaacttatcaactgtaatggtggtgtaacatatatacattgtactgctggacttggaagagctcctgctgttgcattggcttatatgttctggattcttgggtacagtctcaatgaaggacatcggctgctacagagtaaaagggcttgctttccgaagttggaagccattaagttggcaactgctgacattctgacaggattatccaaaaacacaatcactttgaagtgggaagctgatggttcttcctctgttgaaatttctgggctcgacattggctggggtcagagaattcctttgacatatgatgaggagaaaggagcttggtttcttgagaaagagttgcctgaaggacggtatgaatacaaatacgtagtggatggcaaatggctatgcaacgagcatgagctgataacgaaaccgaatgctgacggccacgtgaacaactatgttcaggtctccagagacggcacgagcgatgaagagaaggagcttagggagcggttgactggtccggaccctgatctcacggaccaggagaggctgatgatcagagagtacttggaacagtacgcggatgccgccgagcgctag

SEQ ID NO: 30 - DNA, 1122 bp, Sorghum bicolor
  misc_feature (1)..(1122): SbDSP coding sequence
atgaactgcctccagaacctgctcaaggagcctccaatcgtgggatccaggtcgatgaggcggccctctccgcttaatctggcgatggttcgcggcggcagtcgccgatcaaacaccgtcaaaactttgcaggcaccaggggcgtccacttccggtgccgagagcagcgccgtcgagatgggcaccgagaagtctgaagtgtacagcactaacatgacgcatgctatgggagcagcgttgacatatagacatgaacttggaatgaactacaatttcatacgcccagacttgattgtaggatcctgcttacagagcccacttgacgttgataagcttcggaagattggtgtaaaaactgtattctgcttgcagcaagattcagatcttgaatattttggagttgacatcggagccatccaagattattctctacaattcaaagatattatgcactgccgtgctgaaattagggattttgatgcttttgatttgcgattgaggcttcctgctgtggttagcaaattgcacaagcttgtcaactgtaatggcggtgtaacatatatacattgtactgctggacttggaagagctcctgctgttgcattggcttatatgttctggattcttgggtacagtctcaatgagggacatcagctgctgcagagtaaaagggcttgctttccgaagttggaagccattaagttggccactgctgacattctgacaggattatcaaaaaacacaatcactttaaagtgggaagatgatggttcttcctctgttgaaatttctgggctcgacattggctggggccagagaattcctttgacatatgatgaggagagaggagcttggtttcttgagaaagagttgcctgaaggacggtatgaatacaaatacatagtggatggcaagtggctatgcaacgagcatgagatgttgacgaaaccgaacgctgacggtcacgtgaacaactatgtccaggtctccagagacggtaccagtgacgaagagaaggagctaagggagcggttgactggtccagaccctgttctcacggacgaggaaaggctgatgatcagagagtacttggaacagtatgcggatgccggggagcgctag

SEQ ID NO: 31 - DNA, 1107 bp, Oryza sativa
  misc_feature (1)..(1107): OsDSP coding sequence
atgaactgcctccagaacctgctcaaggagcctccaatcgtgggatccaggtccatgaggcggccctcgccgctcaatctgacgatggttcgtggcgggagtcgccgatcaaacactgtcaaaaccgcatccggggcgtctacttctagcgccgagagtggcgcagtggaggcgggcacggagaaatccgatacgtacagcaccaacatgacgcaagctatgggagcagtgttgacgtatagacatgagcttggaatgaactacaatttcatacgcccagacttgatcgtgggctcctgcttacagagcccacttgatgttgataaacttagggacattggtgtaaaaacagtattctgcctgcagcaagatccagaccttgaatattttggagttgacatctgtgccattcaagaatattgtctacaatgtaaagatatagagcactgtcgtgccgaaattagggattttgatgcttttgatttgcgattgaggcttcctgctgtgattagcaaactgcacaagcttgtcaaccataatggtggggtaacatatatacactgtaccgctggacttgggagagctcctgctgtgacattggcgtatatgttctggattcttggctacagtcttaatgaagggcatcagctactacagagtaaacgagcttgctttccaaagttggaagccattaaattggctactgctgacattctgacaggcttatcaaagaattccatcactttgaagtgggaaagtgatagttgttcttctgttgaaatttctgggcttgatgtcgggtggggacagataattcctttgacatacaacaaggagaaaagagcttggtatcttgagagggagttgcctgaaggaaggtatgaatacaaatatatagtggacggcaaatgggtgtgcaatgacaatgagaagaagaccaaagcaaatgctgatggccatgtgaataactacgtccaggtctccagggatggtaccagcgatgaagagagagaattaagggagcgtttgactggtcaaaatcccgatcttacgaaggaggaaaggctgatgattagagagtacttggaacagtacgttgagcgatag

SEQ ID NO: 32 - DNA, 5955 bp, Zea mays
  gene (1)..(5955): ZmDSP gene
atgaactgcctccagaacctgctcaagtaagcgcccctccctccctccctcctcgttccgtttcggtccgtcctccggtaacgcgctcgcctgctccgcttggctcatggattttcctccagggagcctccaatcgtggggtccaggtcgatgaggcggccctctccgctgaatctggtgaggcttcggacccatccatccctgcgtttctgtggacattctgttctgttctgcgttcccccatctcaatctgacttggttatctgtgggcggttaggcgatggtccgcggcggcagtcgccgatcaaacaccgtcaaaactgtaagcattagccccccacctcgtcgtttccgatttcattccgacaacggaaatcttatcctcacactgaggataaggtgtcccgatagaggctggcaggctgcaatgggtgctgaatcgtcggttactgttgctgttactgtcagtgcggatgtcattccgttacctcgttgacgcccgctcggctgctgaaccaatgttgtgggttgccagttgcaggcccctggggcgtccacttccggtgccgagagcagcgccgtggagatgggcaccgagaagtccgaagtgtacagcactaacatgacgcaggctatgggagcaggtaaacagaatgtttgcttctgtcctgtgtgcgctgcttgtagtgttaggccttgttagacgctgactgtcttatcgcattctgggcaaattggttgctgactggatggatttgtagccggaaaatgaaaagatgttttcctagactcctacgtgtgtcacagtcagagtgttgagctgtcagtgtgatcagaccacatgtgaaacaaacactcactctccattctggtctaccgaccgcttgcttcctggattcgtacacaatttggcgattatgaacagttgtttcacctaaacacgcttcctgcatgtttaacttaccacggcccagtctgcaaacacctgttcaacaacaaatatcccaatttcatgcttcaacattgtgcttgccatctaatttttgtgattgcgttatgcttttagtaagtttggtctattaacttatctgatatgtgtttcttttccccccatgttattatagcgttgacatatagacatgaactcgggatgaactacaatttcatacgcccagacttgattgtaggatcctgcttacaggtgctcgtcgcatccttctttagacagaaatatcgctccctacccctgtctgattatctgcattcatgtgcagagtccacttgatgttgataagcttcggaagattggtgtcaaaactgtattctgcttgcagcaagattcagatcttgagtatccccactaacattttgtaacgcgtctcttaaagctagtctactgatttggctaaactctcgatagcttctttctcgttttctttggtcccgcttgtaatttctttttttcacttcaaaaagtttcaataaaatcgcgctgtaggggtttcccctacagccctctccccctcaaaaaacattttgtaacacataatcagcttacttatatgaatctttttatttggagccataaattttgaacacccttttaagggctcaaatttgctagaccagacagcttgtttagcagttgtacagttaatcccttcatttcagcaacaaaaacattaaaacagtctcccagtctttgtaattttgtaatgaattattagatggtacctctgatttcaactgagaagctgcttgggttacttccttttcatgctgactctgttggatgtcaatatctacataactgaacttagtgccggaggctcccacatgagtggggtcaatatatacaaaaatgaacttcttccctagtagtctagtcttttatacatctatgttggtctatgcagcagaaaccatcatttaaaagttttatttgtattttaataaaatggtgttttttctttccactgccatctaattcttccattctgtgaaatatatctttcttcctttaccaacaaacttgttcagatattttggagtcgacatccgtgccattcaagattattctctacaattcaaagatattgtgcactgccgtgcggaaattaggtagccaaacagtcgttatttcttttttgaagtttggagataagaactttgtggcaaaaatcactgcccttctttatatgcaattaagcaaatccttttcaccatagggtatgtccattagttaagtttataagctgtatagtctattgaggaagtagaggacctgtatttccatcgagcaacacctatatgccagtttgttttcgtagcattgatctaagtccctttttcccattgtcgttattctgcatatttaaactgttcctaatgtttaattacaccagggattttgatgcttttgatttgcgattgaggcttcctgctgtggttagcaaattgcacaaacttatcaactgtaatggtggtgtaacatatatacattgtactgctggacttggaagagctcctgctgttgcagtaggtttacatgccacccccccctaatttttgtttcccaagacaacttattgtttcacagattccttatgtttgtctagagatccttttgcttcagtaggtttacattatttttcttatatagctcatagccaggttgaatgcaagtaaattttttggagaaaaccatgcttatgtgctttagaaaaagtagtaccaatcctcccaagttatgaaattttgcctggataaaaaaccgacatcctatggtgcattaagataaatacagatgctacaatctgcagctctgtagcattttaataacctcaagattgactgggtctaatactctaatttctttccaagttatgcaacttaattagaaaatagtacttagggagatacaccattggctagtctgaacactttttttttgtttgtaaaatttcagttggcttatatgttctggattcttgggtacagtctcaatgaaggacatcggctgctacaggtgattcattgcagttgataccgcctttgtggaatgttcaacaatcagcacttctgtttgtttgaagataagataatatacctattatctgtgcacccgaaaaccaacatctaatgattgcctgcttgtgggaattttgatggtcccccgcatctgttctctatagtccatttatgttggtatacggctagtagacaagttctgtttatttatcagtttttttcgttttgtagagtaaaagggcttgctttccgaagttggaagccattaagttggcaactgctgacattgtaagtgaatgcagaactaatttctcagtagtagttatgttggagaagatgaatacagatcatggcgagtcaaagattttcctactaagtgatggctgtcgtattatttagctgacaggattatccaaaaacacaatcactttgaagtgggaagctgatggttcttcctctgttgaaatttctgggctcgacattggctggggtcaggtacattttttccccttcagttgtgtgtttggagattttttccttctgacggcgagtaagatcagggcatttattcaagctatttaataaattagattatatgctagtatgctactacttgtctacctctcagtgtttttaagtcattgcgattagtcggacttatcggtaacttaaacccgactagacccaccgaagcgattatctggactagaaacctggtcgtccgattagtcaacgattaatcacgattagttgtccaatctggtgtggaacgaccagattaaacatgcgtttttagatgagcttttggagctgtggttgtggactcgtgggttgccatttggtactgcatctatgggctgcaattgtggccttgtagggttgggcagccacagccgcacaagacgcaaaaaccatccgtgtatccttgctgctgcagtgccccttccgccgccgcacaagttcacagtcctgtccccgccctcaaggccacaagacccaagtggacgcctaccctaccgcagtgccgccccccgccctcatgatacagctccaaccttctaggcggacactcaagctccactgctggtgcctgcaagatccaacaaaatccgccgtcttccaggttcaagcatcgtcgcccaggcccaactcttgtgtgtctgtctgcatcaagcaacgatagacacaatcccaaaacccaaaagatgagctcatcagcagatggtgacttcgtgactgtgcttcttgctgctctgcttttctgcttgttgccttgtgttacttgctatagcccgtggcatgtgtcccttcttgttgctactacgcttgattagtcagtctggtcgatgactaatcgcgactagtcgactgatcggtagctatacgagtaggttcgactagacaacttgaaaacattgctaggctctggccatatttatatgatgttccaacaaagcagttctttgttgattgagtaagcccccctgcggttggtacaccatatatgttggactggagagagcacatatacattctgtatgaggtttagtggattaaactagcaatatatctctatgtcgtttcttactttttcgtggataaaacttggtcattcatctgagttttagcatgcaagctcagaaacgttgtctcaaataggaaggtccatgccctgattaattcttaacgttggcactgattgtaagtagcaattttaatgcagctgtattgttgtcaacaacgcagcaggttactataaactatgaaaaacaggttatttaggttttggatattcttcattttgtcgtatgcactacagttaacgttgtgtacctgcaggctataataaaatgctctaacaaattctcctgtttaggccctgtttggaacacctagagctaatagttagccagctaataaattattagcagggttgagccagctaataaactaattgttagttgtgaggtagctaataattagctacagtattagctgatggtgtttgaactcaacaactaatttttagtagctaactattagtttgaggttccaaacaggaccttagtatcaattatggagaaacatgatatgtatgcagtactatctgctaccggtttgcacaactgtgtcttacgatctgctttagctagatgtgcctaaatcaaatttacaaatatgattgtccctcagctgctaggggctatgatggttgaacaagcccatctacctgttacatgtttttattagatataatcccgtgcataagtctctaactgatttctatttatcctttcagagaattcctttgacatatgatgaggagaaaggagcttggtttcttgagaaagagttgcctgtgagtatacaatgtttatgttaggaaccatctaaaagtttatggaatgttgatagtttcattgtggaacgtaggcagctcttgaccatacctggtacatgtagaccatatctgtgtgcgacatcctgcttgatcatttatgatattacattcgaataacctcctcttagggaattttgaaagcccagaaagattgtaagccagtatggctatatcttacacctttgggatatctgtttcctgaaggaaggacggtatgaatacaaatacgtagtggatggcaaatggctatgcaacgagcatgagctgataacgaaaccgaatgctgacggccacgtgaacaactatgttcaggtgagatcctcctgtcccgtcaaatggatgccatagctgagggctgagagtgcacgcgtttttcttggctgcaggtctccagagacggcacgagcgatgaagagaaggagcttagggagcggttgactggtccggaccctgatctcacggaccaggagaggctgatgatcagagagtacttggaacagtacgcggatgccgccgagcgctag

SEQ ID NO: 33 - DNA, 5007 bp, Sorghum bicolor
  gene (1)..(5007): SbDSP gene
atgaactgcctccagaacctgctcaagtaagcgccccctccccatccctccctcctcgattcgcttcggttcctcctcgctctcgcctgctccgctccgctccgctcatggattttcctccagggagcctccaatcgtgggatccaggtcgatgaggcggccctctccgcttaatctggtgaggcttcgggcccatcccatcccctgtgttcctgtggacattctgttttgttttttctcaatctgattccgttgtctctgggcggttaggcgatggttcgcggcggcagtcgccgatcaaacaccgtcaaaactgtaagccttagcgccacctcgtcatttctgatttcattccgacaacggaaatcttagcctcacaccgaggataaggtatctcgatagaggctggcaggctacaatggctgaatcgccggttactcttcctgtcagtgctagtgtcgtttcgttacctcggctgttgaatcaaacgttgtgggttgccagttgcaggcaccaggggcgtccacttccggtgccgagagcagcgccgtcgagatgggcaccgagaagtctgaagtgtacagcactaacatgacgcatgctatgggagcaggtaaagagaatgtctgcttctgcatgtgttgcttgtaggccttattaagacgctgactgtcttatcacattgtgggcaaattgattgctgctgatgaatttatagccggaaaataaaatatttcctaggctcctacgtgtgtcacaatcagagtgttgacctgtctgtgtgatcagaccacatgtgaaacgaacactcaactctccattctagtctggcattttcctttcagtctgcttcctggatttgaacataatttggcgcttatgaacagttgttcctgaatgaatgtttaacttaccatgtccagtctgccaaaacctgatcctgcgatagtgcttcacatgtagttttgtggcaacaataattgtgtccccacttcatgcttcaacattgtgcttgccatctaacccctgtgattgcattgctcttttagtaagtttggtctattaacttctctgatatgtgttccttttttcccttgttattatagcgttgacatatagacatgaacttggaatgaactacaatttcatacgcccagacttgattgtaggatcctgcttacaggtgcttgtcacatccttctttatacagaaatattgctccatagtccctacctccgtctgattatctgcattcatgtgcagagcccacttgacgttgataagcttcggaagattggtgtaaaaactgtattctgcttgcagcaagattcagatcttgagtatccccactaatattttgtaacgcatgatcagcttacctatataaatctttttatttgaagccatcaatttcgagaaccccttttatgggctcaaatttgctaaaccagcagctcttttagcatttgtgaagttaatctcttcatttcagaaataaacacaacaaaacactcctaatctttgtaattttcatgaattattagatggtacctctgatttgaactgagaagctacttaggttagtcccttttcatgctgactctgttggatgttgatatctgtaaaaatgaacttctgcccatgtagtctaatcttttgtacatctatgttggcctatgcggcacaaaccgtcttccaaaagtttgtttgtattttaataaaatggtcttttgttgttgccacgccatctaattcttccattccatgaatatatctttcttcctttaccaatcaacttggtcagatattttggagttgacatcggagccatccaagattattctctacaattcaaagatattatgcactgccgtgctgaaattaggtacccaaactgtctgttatttctttttggaagtttggggctaagagctttgtagcattaaacactggccttgtttatacgcaattttgcaaatccttttcaccatggggtaatgcccattagtcaagtttataagctgtatagtttcttgaggtagtagaggatctgtatttccattgaacaacacttatggcagtttgttttgagagcattcatctaagtctcttttccccgtattgctgttattctgcatatttaaacagttcctaatgtttaattacgacagggattttgatgcttttgatttgcgattgaggcttcctgctgtggttagcaaattgcacaagcttgtcaactgtaatggcggtgtaacatatatacattgtactgctggacttggaagagctcctgctgttgcagtaggtttacatagccttttttcccccaagacagcctaccgttttacagagtccttttgtttctctagagatccttttgctgcagtaggtttacattgtttttcttatatcgctgaccaggttgaatgaaaggaaacttttttgggggaaaaccatgcttgtgtgctttagaaagagtactaagtaccaatcctcccaagttacaaagttaatctagataaagaaaaagagagcatcccatggcacactgacataaatacaaatgctacaatctgcagctttgcagcgctttaacaacctcaacgcactgacataaatacaaatgctataatctgcagccttctagcgctttaataacctcaagatttgattgggtctaatttcttccaagttatgtaacttaatttgaaaatagtacttaggggacacattattgctacaatttgttgttgtccacagccttgagcattgttattttgatggctttctaagttcaagcatttttttttttgtaaaatttcagttggcttatatgttctggattcttgggtacagtctcaatgagggacatcagctgctgcaggtaattcattgcagttggtaccacctttttggaatatttcagcagttctgtttgtctgaagaaaagataatattccgattatatgtgcactggaaaactaacatctaatgattgcctgcttgtgggaattttgatggtcccccgcatctgttctctatagttcatttatgtcggtagtcccagtgctgttaccgtatagctagtagacaagttctgttgattatctgttcttaaactcaattttcattttgtagagtaaaagggcttgctttccgaagttggaagccattaagttggccactgctgacattgtaagtgaatattgtactaatttctcagtagtagttatgatggagaagatggatacagattatggtgagtcaaagatttttctatttagtgatgactgtcttattatttagctgacaggattatcaaaaaacacaatcactttaaagtgggaagatgatggttcttcctctgttgaaatttctgggctcgacattggctggggccaggtacatttttccttcaattgtgtctttaaagattttccttttgaatgtgaataggattagggcatttattcaagttgcatattaaattagatgctgctacctgcctacctctggccatatttatatgatgttctgacaaagcagtctttgttaactgaactggtccctgcggtcgggatgtcatatatattggattggagggagcacaccacatatatattctgtacgagtcttagtggattaaactggcaatatacccttatgtggttgctttgtggatgaaactaggccattcatctgggtttcagtatgctagcacagaaacattgtctcaaacaggaaggcctttgtcctggttaactcttaatgttggcactgattgtaagtagcataattttaatgcatctgtcaagttgtcaatatgcagcatgttacttaacgttttgtacctgcagactacaataaaaggctctcgcaaattctcatgatttgtatcagttatggagaaaatgatacgtttgcacaatttaggtcttacaacctgcttcagatagatatgcctaaatcaactttacaaatatgattgcccctcatccgctaggggctacgattgttgaacaagcacatcgacctgttacatgtttttattagatataatcccatgcataatctctaactggttgctatttattctttcagagaattcctttgacatatgatgaggagagaggagcttggtttcttgagaaagagttgcctgtgagtattataaaatatttatgttaggaaccatctaaaagttcatcaatattcataaatgcattgtcgaatgtagtcagctcatgaccatacatggtgatatggtatatgtagaccatctgtgtgttgacatccagcttgatcatttatactgtatactcccatcccaaattataagacgtttagtcaaatttaagtcattcttgaagaacttttattaataaaccaagccacgacaaaagaagtgatattttgcacaaatttttgaataagacgagtggtcaaacttggtgttaaaaaagtcaaacgtcttataatttgggatggattgagtatatccttgcacccttgacttatatagaaatataactctggccatcctgtgtgtctggaaagtcttatgatgactgcagcgttcttgacaaaaatattgtctgttatacctttgaacaaaacataggagttaaattttatactcgccatatggctatatcttacacctttggcatatctgtttcctgaaggaaggacggtatgaatacaaatacatagtggatggcaagtggctatgcaacgagcatgagatgttgacgaaaccgaacgctgacggtcacgtgaacaactatgtccaggtgagatattgtgaatgagtcaggtagatgtcattagctgctggctgaggctgcatgcttttcttggttgtaggtctccagagacggtaccagtgacgaagagaaggagctaagggagcggttgactggtccagaccctgttctcacggacgaggaaaggctgatgatcagagagtacttggaacagtatgcggatgccggggagcgctag

SEQ ID NO: 34 - DNA, 500 bp, Zea mays
  5'UTR (1)..(500): ZmDSP gene 5' UTR and promoter
tagcgcgtacgagacccgtcgccgtccggtcgctttcgcgcggcgaaaagagggaggaagaacgggtcaagaggctataaacgagggtgggcccactcgatttagccaacaccaaaactaccgcggcccacgtcacgggggcctggagagttacgtgggcgcggtccatagaccaatctccctccccactccgaccccgcagcgcggaacgcggcgtggtccacgaggggccgcacccgcacggcatgatgggcttaatagaccgagtccacgccacgcggacgctcctcccactcctctcttgcccgcccgtccccggtccccgtcgtccctctccctagtccctcccctcgtccgtcgtccacctctgccactacgagctcgtccccgtcttgtttcgtctcctctcgtctcgtcacgcgagatatttctacgggacgggacccgcgttgcttccccgcctcgccgtcccgcgcgcgccagccgggcccggggaagcc

SEQ ID NO: 35 - DNA, 3000 bp, Sorghum bicolor
  5'UTR (1)..(3000): SbDSP gene 5' UTR and promoter
accaacacgtcattaagattgaaatgaaaccaaaataacccaacaatgaagcatttcactttgttgtttccaaggctaagtaaagcatttaattactacaaaattattggatcacatgcaagatggtgaaaagatttagccttcattggggatttcatcccgtttcaccacgtgggaaacaacgcccgcggggtttcaccatggtgaaactacttccttctctctcttcttcgtttcatgcaaaaagtgcagttttgctgacatgacgctctaataaatgtgcatgccattctggtaaaacccccaccgaaactggcctaaatgactttctttatgaatatagaggaattactctttttatatctcaggtgggttgtgtgtgtgtgtgtttcatattaaatttaattttattattgtttgactaatttaatacataaattattttttagttataataaagtttgttgtcaaagactatagtccgaaaactaattagtaacttccttaaaaaaataatacttagagcaacaactccaacgcattatgtatatctttcttaaattataggaataaatattttaatgaaaaatactttgcaagcctccttaattagtttttttaaaatatttatatagtattctagatttttcgctagtaaaaatggagagtgaggatatctctttataatgtgcacaagatatagaaaaaaaactgttggaaggtacaaagacatagaaacgtgttttttactcagatgacactccaactaatgatttagaaagtaaattttagaacactccaactaatgatttagaaagtaaattttagaacgactcttggagatggtcttggttacccatgtctagttttacaagtgagcatgtgcttcaataaccatgctactcactagattgggttttgtcataataccatatatatatatttcaaatcaagtatagtgtgcaaatctctctctaaaggttaggttggaaacttcgatccttttgtcgtcctagacttttttagagtagcaattcacgggtatgctatttcagctagtcacttagttctttgtatagggctttctatctctggagttttctcattattattgtaaatgatatgagacttatatctagagcgcatatagatatgagcttcccgtacatcacattcaacaatatggtgtgtgcaagtttcccatcacgtggagtcctttattgcgaaagaatgtaccatgttttttgagtaatgaatataactccccccccaaaaaaaaagtggccattttggtctcgtattttgtcaagtacataaacaaacatcaattggagtcatttctatttcaatgttttttcttctggccaaatagaaacattaattggagcatgttttagacatatacatcgattcaagtttcagacatttctttatactgaataatcaatgtatcctccacaaaacagttaacatattcatgagacgctcagaaccttacatatgttctattcaattctactttagaaaaagaagtaagcaaaacttaaaacatcaagtgattaaaaacaagttagagcatctttacttgctctcttatatgacatctcctataaattattttaggagagtaccttaaagtaaatatagttataagagagactattgtagtggattatctaaaatttctatcttatactactttagcgaaaagggagcgcgagttgtctcatttattcatgagaaaggatgattttttctagaaatcttgttagaatcataggtgtagaagatattgataggagcaacaggtatatcttctaaaaaccacattttatttatagaaaatcagataggatatctaatggagattctctaagatttgcaatatcaaatctatttgtggcatataatttataagtacaacaactttagccatatgtgtgaggcaaggagagccctcgaggaacataggccctgactaaatacctttataatcaaattattgatctccaaccataagaatcacaaatgccaaagattttgtatttttggcgattcccatgaccataagagactctccaaccacaagattaaactaaaataaaatccgatttcgcatagcgtggctccactgccgcaccgcacgattgtagaacgcgtatcctaatagagacatagtgatgctaatgatccgtttgtcatcaaaatagacaaggagtgattcaccaaggcccttggcatttgttacaaatgctacaacaatgttgtacatactccagttttctagaattaacactgtgatacaagatgcatggccaaactgaattacaattgtcccatttggcaccccattttgtggggaacaaaaaatcataaaagcacgtgggcgcgaagtggtcgcgcgcgcacgagcgccaaacacatcgcggcggataaacaggacgtgatccacgctgcacagcaaaaggacggtcgatctatcgacacgtgcggcgtggctggccgtccgatgcgacgcgcgccaggcacgtgagcggtacaacatgacccgtcgccgtcctatcctatggctttcaccctacggaaccgaagaacgggtcaaaaggctataaacaagggggcgggcccactcgatttagccaaagcaaaaccaccgcggcccacgtcacgggcccggtgtgcgcgtgggcgcggtccatacaccgctgtccccttccccatccccgcacccgcacccgcagcgcggaacgcggcgtggcccacgaccacgaccacgaggggccgcacggcatgggcttaatagaccgcgtccacgccacgcggacgctccccccactcctctcctgccccccccgcccgcccgcccgtccccgtcgtccctcccctcccctctccgtcgtcaccgctgccactgcgagctcggctcgtctcgcctctcgcgccagacgggacccgcgttgcctcgccgtcccgcgcgcaccagcccggccgggggaaacc

SEQ ID NO: 36 - DNA, 2000 bp, Zea mays
  3'UTR (1)..(2000): ZmDSP gene 3'UTR
gaggtccagttgagaacaactaaccctattcctatgtgctggtgtataaacaaacaagctcattgggatgatcactcaggtggtactgggtactaacaagtatatgcgtatgacatgaactgcagaagaatgatgatgactgaggaagagaagagacacaccatgagacgacggaccgaagccgacctgaccgcaccttcctttacggagaggtcgggcttcccctctcttgtcaatcaaatactcgtagcttaaccgtgcaaaagggcacgttctgctcgcatacttggagaatgatgatgaaggagcaaactgtacgtattgttgaacagcagctgtgcagaaataacaaaggtagtagcgtaaaactactgtactgaccataatgttactactgtatgctccttcttggctatgaataataataataataataaaagagtaaataaacctcatcgatcccttgttatgcttttctgtgattggtacctgagagagagaggctgaatacgagacaaattaaaggcattctatggcttcttaaaattattgatgaaaattgcaagagatcttgcaccatgatgaaaccgagtgagggactgaggcctgaagcctgagtcggactgcctcataaccctttttatttttaggtgcttgtctttttttacctccgtctataaaaaataggcttctatatttttaaacattactacaaatcagatttctattttttaaaagtttttatttaataaattctaaactgtccatatcattgtccgactgagctctgaatcttgtggctaacatgatggcacgttgaacaaaatttgttatgaaagccccctagagaacagatatacaattctagtttctgcattggaagtgtcgtaagaaaaatgaaaatgagataaaaaaaacacaggaccactatgtagctatggtaatgagatcccggcgaagaatcgagtggcaaagtagtcccaccactacagtacgactactgatcctagcaaggcagcgagtgactcactcagtagtggtccagagaagaagacgagcatcaggaatgagaatggcaactgagctctgccctcgatcacttggatcactcgctccactttacgctctgccaagcaagctgcactctaggacactttgcatggatcacttggataactaaaaaaactgcataaattcatacaaaataaataaatataaaagttaaaatttttaaaataaaaaccatgtagttcgtgaaaattcaacatagtactacttatcgtcattctccccaaattttttgcattttgacccttaaataggaataaaatcacgtttagaccctagtaaattttaatatcaattttggacccttagctcggcgccatagcctatggcgccgaggtaacacatgtcggcgccactgtggcgccgagctctgacgtggcgatgacgggtagggctgatgtggcagaccgcgtggcacctagcttggcgccacagattttggcgccgagctaggatgtagtcgcacgactctcttctcactccgttttcaccgccgcgcaaatcacccttaccgccgccgcgccgccgagctcgccgagcgctgcccccccccccccccgagcccgcggctctccaccacgcccctagcgcgcgccgcccgagcatgcgccgccgccggcccggtcgctcccgtaccgcctaggcgctcgcctgcgacgcccgccgcgccgcccgagcgccgccggccctctgctcctcgcccttcgccgcgccgcccgagccaccacaggctactcaaggtaatttttttactaattttaaaatattttatatgtatttattttgtgttaattgtttagttagtttttagttatttataattagttctcataccatgtgccatttatttgatatatgtatttattggttagtaatgagttaggtttaggtattagttattagttagtcgttagtgagtagtcatttatttt

SEQ ID NO: 37 - DNA, 2000 bp, Sorghum bicolor
  3'UTR (1)..(2000): SbDSP gene 3' UTR
gaaggtctggtgtataaacaagcaagcgcattgggatttggtggtactgggtactaataagtatgtacgtatgtatgacataaactgcagaagaatgggctcgggtgcagtctgggagcagaacagtagaccatggtgatgcctgatgcagagacgagacgacggaccgaagccgacctgaccgcaccttgcttccttcccttcccggaaacgtcgggcttccttccccctgttgtccatagtacagtagcttaaccgtggaaaagggcacattctgctcgcatagttgaaggaccaaattgtacgtaagtattgttgaacagctgtgcagaaataataagtagtagcgtcaaactagtgactggaataatattaatagtaataaagttactagtgcatgttcctgaatgaatgaataaagagtaatcttttggatcgctgttactgtaccgagtttgtgctgtgcctgtgaggcctgagtttttttttttggattttagtattttcgtttttatttaataaatattattcaattatagattaactaatcttaaaggattcatttcgtgatttatagataaattgtacaattagtttttgttttcgtttatattaaaatttgatgtgatagaaaatctttaaaaaaaattagtttgttttgggggtaaactaaacaaggcccgacatgaaaaatgaaatgcaatttattaggtcgcaactgagaagacggtttggtgcagcagcaccgaaaggtgatgaatgtgtgtggacttgtaggcagagtcaagtgtcaaagtcgccgttgctgttccttcccgtggaagtcaaagtcgggcggccgcatcagaagttgaggcgagagctagtggtggtggaccggtgggtggaaggtgacccgcaccccgcacccacccagacggccaagccaaccaatccttctactcctcctccgtaccagcaccgaattcgcaatcatcataccaaagattttgaaatgaaaatctggcgttggcgcaaagcaaagcgaaacacaggaaggatcattctctcccttttcgagacagacaatacataagaaaaataaatgaatgaataagcagcaagattttgattccatttattttatgtatataagtaagagtagtaaaattgatttttacagactggagtggagtattggtagggcggcaactttgattattgatttacacaagtactaacactctagtaaatgaatactaaataaaaaaaaaagaagcactcctagctgaaaaatgcggttgcttgttacaacaagggacacaacaagcagtgagaaaaggaaaataaagcagaaagactgcttgcaagctacgctaaggtgaagattgagcctcagcttgagcttgaagtcaacttgttgaaaggattactacttcaagctgcgcagtgtttgttggcggaggcggagcggcgtcgcttgtcggtggtggccggcggtggcgggtgcgggtgcgggcggaagaggcgctcgagctcgtcgaggcggaggctgatgagagggacggaggaggggtctgcagcaggctgatccccctggaagaggcgcttcctgcacggcggcttcctgggcgccggagggcacgtggtgggctccctgaggtaggagatcctgctgcccgtcggcgtcctgcaatcgtagtcgtagtcgtcgccgaacacgagcggcgggagcgcggcgcaggccggcgagaaggccggcgcgccggcgggcttgaagaactcgggcgaggcggacatggtggccggcttgttgttaccttgttggcagcgaggtggtggtggtgcaggtgagcctgaggcaaggagcagagcagagcgagtggtagcagccacgtcacacgagcgagcgaggtggactggtggtggtggtggtggtggtggtgttgctatatatggaggaggaaggaggaagagagaggagcaggcgtggatgaatacgcgtcttctggtggaagaat

SEQ ID NO: 38 - DNA, 245 bp, Oryza sativa
  misc_structure (1)..(245): OsGWD amiRNA1wmd3
cagcagcagccacagcaaaatttggtttgggataggtaggtgttatgttaggtctggttttttggctgtagcagcagcagtatgtagggacactaacgcatcaggagattcagtttgaagctggacttcacttttgcctctctatgcgatagagtccctacatattcctgctgctaggctgttctgtggaagtttgcagagtttatattatgggtttaatcgtccatggcatcagcatcagcagc

SEQ ID NO: 39 - DNA, 245 bp, Oryza sativa
  misc_feature (1)..(245): OsGWD osa-MIR809aM1
cagcagcagccacagcaaaatttggtttgggataggtaggtgttatgttaggtctggttttttggctgtagcagcagcagtaggattgcaacgagtgtaagcaggagattcagtttgaagctggacttcacttttgcctctctcttactctccttgcaatcctattcctgctgctaggctgttctgtggaagtttgcagagtttatattatgggtttaatcgtccatggcatcagcatcagcagc

SEQ ID NO: 40 - DNA, 538 bp, Oryza sativa
  misc_feature (1)..(538): OsDSP1
tatggttgacaagcttgtgcagtttgctaatcacagcaggaagcctcaatcgcaaatcaaaagcatcaaaatccctaatttcggcacgacagtgctctatatctttacattgtagacaatattcttgaatggcacagatgtcaactccaaaatattcaaggtctggatcttgctgcaggcagaatactgtttttacaccaatgtccctaagtttatcaacatcaagtgggctctgtaagcaggagcccacgatcaagtctgggcgtatgaaattgtagttcattccaagctcatgtctatacgtcaacactgctcccatagcttgcgtcatgttggtgctgtacgtatcggatttctccgtgcccgcctccactgcgccactctgggcgctagaagtagacgccccggatgcggttttgacagtgtttgatcggcgactcccgccacgaaccatcgtcagattgagcggcgagggccgcctcatggacctggatcccacgattggaggctccttgagcaggttctggaggcagttcat

SEQ ID NO: 41 - DNA, 449 bp, Oryza sativa
  misc_feature (1)..(449): OsDSP2
tttgataagcctgtcagaatgtcagcagtagccaatttaatggcttccaactttggaaagcaagctcgtttactctgtagtagctgatgcccttcattaagactgtagccaagaatccagaacatatacgccaatgtcacagcaggagctctcccaagtccagcggtacagtgtatatatgttaccccaccattatggttgacaagcttgtgcagtttgctaatcacagcaggaagcctcaatcgcaaatcaaaagcatcaaaatccctaatttcggcacgacagtgctctatatctttacattgtagacaatattcttgaatggcacagatgtcaactccaaaatattcaaggtctggatcttgctgcaggcagaatactgtttttacaccaatgtccctaagtttatcaacatcaagtgggctctgtaagcaggagcccacgatcaa

SEQ ID NO: 42 - DNA, 590 bp, Oryza sativa
  misc_feature (1)..(590): OsGWD1
tcagttcgtgctgcttcatactcctccttctcttgctcaggtgtatatgactgctttccctttctttcccaccgaagatatgattgtatctgcacaagatcctctggaaccacagtagaagaagtagcagtagatgtaccctgcccttgatattggctcgcttgtagctgaatttggaaattctggccattgtttttgtaccaattattccgtgcctcatcaaatatgaggaactcaatggcttgcactgcaggatcatctatctcaattttcagcgtggagttatcacctgactttataaaaggcgtcctaagagccctgttcttgtacactgtcgtgccatctggtttccgggatggtaggagccattctcctctatccgggcgaagggcgccccaatgcagtatcagggagccgctggtgttagttgcctctagattgatctccaccaccgaaccctgcggtgctgggttcaatgtcaccttaagctcggagttggcatccagggtgaaccttccgacaaggcccggggaggcgcggccggtggaagcggcgatggcgcgaggggcgaggaggctccgacgggagac

SEQ ID NO: 43 - DNA, 452 bp, Oryza sativa
  misc_feature (1)..(452): OsGWD2
attcttctgctgatattgcatattttccaagaaacttcttcttgactaatgacacagatggcactgcctggccagcttctgcatttagagaacctgattgcagttcactctctggaatctccctataggtgatatctgcagaagtaggtttgaaggaaaacactttcccatcatgtccttggagttcagacaaggtgttaggatcaaagcatgttgcaaataaaaccttgcaattccttgctcggactgatacatgggagagaacatctggcatatcaggtgtaataacaccaacaactccatctggtatttcttcctctcccttgacactctttgccacaaggatagttggtttatcataggatttgttttgaacagcaagcaattcatcaaccactacaatgtaacctgatacttcaactgggcttataacctgccaacttccaagctgt

SEQ ID NO: 44 - DNA, 466 bp, Oryza sativa
  misc_feature (1)..(466): OsPWD1
aaagagttctgcatgcagcagcttttgcaccagctgattccactgaagcttctgaaagctcaagagcagcaaaactaccattcactcctgatttgcttttttgcttagacatttgcagtggcatctcgatatccgatggtagagagaattcattttggagtttctgttgaaatggattccctgtactatttggttctgtagagacagcattgtcatttttttctgaaactattgagagattgacattgatggatgatgcttctaatctgatatattttccctcaagcaaatacacatctgtaactgtgtcatcatattcacaagttacaaatacaacattctcttgacgagctctaacaccaagatgtgaaaggtgaggtagttcctgaagaagaataacaccaactatattatccccagcagctttgacctcttcatctccatcagccttatctacaattagaac

SEQ ID NO: 45 - DNA, 450 bp, Oryza sativa
  misc_feature (1)..(450): OsPWD2
tacttccttgccattgcccaccaaatttgcttgactcggcctctggtgctggatcaccattctcaacaactgaaatatcttgaactttttcaggtgcaaaagttacagatgctgaagcatcctcgccagtattcttttcagcttctccgaccaactcaaactttggtgttcctaaaagttctaatggctcttctgttctattccagtggcatactatatcaaacttaccatccttcggcagctcaacaacacggttattaccatcttcccatattttatcttttcctcccaccaaaaatataacaaatttaaactccacaagtgtttctccagggagcttaagctggcagacccaaccatttgtagtccattccagttcaacctgctcctcccatgaaccaagctcctttgtggaaccgataatgcctacatgctcaccaaacttaacct

SEQ ID NO: 46 - DNA, 164 bp, Sorghum bicolor
  misc_feature (1)..(164): SbGWD
gtgagataagcaaagcacaagataggtttacagatgatcttgagaatatgtacagaacttatcctcagtacagagagatactaagaatgataatggctgctgttggtcgtggaggtgaaggtgacgttggtcaacgcattcgtgatgagatattagtaatacag

SEQ ID NO: 47 - DNA, 446 bp, Sorghum bicolor
  misc_feature (1)..(446): SbGWD1
tcctcccatccagacaacctgatggaacgacggtgtacaagaacagggctcttaggacgccttttgtaaagtctggtgataactctactcttagaattgagatagatgatcctgcggtgcaagctattgagttcctcatctttggcgagacacagaacaaatggtttaaaaacaatggccagaattttcagattcagctccagtcgagccgccatcagggtaatggtgcatctggtgcctcctcttctgctacttctaccttggtgccagaggatcttgtgcagatccaagcttaccttcggtgggaaagaaagggaaagcagtcatacacaccagagcaagaaaaggaggagtatgaagctgcacgagctgagttaatagaggaattaaatagaggtgtttctttagagaagcttcgagctaaattgacaaaaacacctgaagca

SEQ ID NO: 48 - DNA, 540 bp, Sorghum bicolor
  misc_feature (1)..(540): SbGWD2
cttctgaaccgatttgatcctgttctaaggaacgttgctaaccttggaagttggcaggttataagcccagttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtcccatgtgtcagtccgagcaaggaatagcaaggtactgtttgcaacctgttttgaccataccactctgtctgaacttgaaggatatgatcagaaactgctttccttcaagcctacttctgcagatataacctatagggagatcacagagagtgagcttcagcaatcaagttctccaaatgcagaagttggccatgcagtaccatctatttcattggccaagaagaaatttcttggaaaatatgcaatatcagctgaagaattcaccgaggaaatggttggggccaagtctcggaatatagcatacctc

SEQ ID NO: 49 - DNA, 497 bp, Zea mays
  misc_feature (1)..(497): ZmGWD1
tcctcccgtccagaaaacctgatggaacgacagtgtacaagaacagggctctcaggacaccttttgtaaagtcaggtgataactccactctaaggattgagatagatgatcctggggtgcacgccattgagttcctcatctttgacgagacacagaacaaatggtttaaaaacaatggccagaattttcaggttcagttccagtcgagccgccatcagggtactggtgcatctggtgcctcctcttctgctacttctaccttggtgccagaggatcttgtgcagatccaagcttaccttcggtgggaaagaaggggaaagcagtcatacacaccagagcaagaaaaggaggagtatgaagctgcacgagctgagttaatagaggaagtaaacagaggtgtttctttagagaagcttcgagctaaattgacaaaagcacctgaagcacccgagtcggatgaaagtaaatcttctgcatctcgagtgcccatcggtaaa

SEQ ID NO: 50 - DNA, 540 bp, Zea mays
  misc_feature (1)..(540): ZmGWD2
cttctgaaccgatttgatcctgttttaaggaatgttgctcacctcggaagttggcaggttataagcccggttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtctcatgtgtcagtccgagcaaggaatagcaaggtactgtttgcgacctgttttgaccacaccactctatctgaacttgaaggatatgatcagaaactgttttccttcaagcctacttctgcagatataacctatagggagatcacagagagtgaacttcagcaatcaagttctccaaatgcagaagttggccatgcagtaccatctatttcattggccaagaagaaatttcttggaaaatatgcaatatcagccgaagaattctctgaggaaatggttggggccaagtctcggaatatagcatacctc

SEQ ID NO: 51 - DNA, 363 bp, Zea mays
  Intron (1)..(363): ZmAdh1
attcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagtt

SEQ ID NO: 52 - DNA, 290 bp, Oryza sativa
  Intron (1)..(290): OsAdh1
gaaggtgatcaagtgcaaaggtcagtgcttttcctcccctccctgtttcttcttggttcgattttgctttggattgggcgaacttttaggcattttattactggagcggcgctgtagatgaaattcttggattgtgttctttttagagttttcttgggtgaacattaccgatcttgcagaagctgtggagaaaagcatatctttttttttagtgaaaaatgtcattcaggattatgtttttttggtggattggtgggtgattttgctggatctgtgcagcggcggtggca

SEQ ID NO: 53 - DNA, 120 bp, Sorghum bicolor
  Intron (1)..(120): SbAdh1-2i
tgggaggccaaggtatctaatcagccatcccacatttgggtcttgtcagtagatatgatgcagcaactcgcggttgacttgcgctttcttggcggcttatctgtcttaggggcagactcc

SEQ ID NO: 54 - DNA, 122 bp, Sorghum bicolor
  Intron (1)..(122): SbGWDi
gtaaaactgatggtccttggtgaatatacagttattttcgttcattgctctgctgaattgagcagttggtagtgctcatccaaaacgtagacattgtcaacaataaaatgtttggtgtgtta

SEQ ID NO: 55 - DNA, 2001 bp, Zea mays
  promoter (1)..(2001): ZmUbi1P
ctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatc

SEQ ID NO: 56 - DNA, 1299 bp, Zea mays
  promoter (1)..(1299): ZmPepCP
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgcc

SEQ ID NO: 57 - DNA, 2068 bp, Oryza sativa
  promoter (1)..(2068): OsUbi3P
accgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccag

SEQ ID NO: 58 - DNA, 276 bp, Artificial Sequence
  Synthetic construct, NOS terminator
tccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 59 - DNA, 2602 bp, Artificial Sequence
  Synthetic construct OsUbi3P:OsGWD amiRNA1wmd3
cgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatgcagatacagcagcagccacagcaaaatttggtttgggataggtaggtgttatgttaggtctggttttttggctgtagcagcagcagtatgtagggacactaacgcatcaggagattcagtttgaagctggacttcacttttgcctctctatgcgatagagtccctacatattcctgctgctaggctgttctgtggaagtttgcagagtttatattatgggtttaatcgtccatggcatcagcatcagcagccctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 60 - DNA, 2602 bp, Artificial Sequence
  Synthetic construct OsUbi3P:OsGWD osa-MIR809aM1
cgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatgcagatacagcagcagccacagcaaaatttggtttgggataggtaggtgttatgttaggtctggttttttggctgtagcagcagcagtaggattgcaacgagtgtaagcaggagattcagtttgaagctggacttcacttttgcctctctcttactctccttgcaatcctattcctgctgctaggctgttctgtggaagtttgcagagtttatattatgggtttaatcgtccatggcatcagcatcagcagccctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 61 - DNA, 3725 bp, Artificial Sequence
  Synthetic construct OsUbi3P:OsDSP1 hpRNA
accgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatgcagatatatggttgacaagcttgtgcagtttgctaatcacagcaggaagcctcaatcgcaaatcaaaagcatcaaaatccctaatttcggcacgacagtgctctatatctttacattgtagacaatattcttgaatggcacagatgtcaactccaaaatattcaaggtctggatcttgctgcaggcagaatactgtttttacaccaatgtccctaagtttatcaacatcaagtgggctctgtaagcaggagcccacgatcaagtctgggcgtatgaaattgtagttcattccaagctcatgtctatacgtcaacactgctcccatagcttgcgtcatgttggtgctgtacgtatcggatttctccgtgcccgcctccactgcgccactctgggcgctagaagtagacgccccggatgcggttttgacagtgtttgatcggcgactcccgccacgaaccatcgtcagattgagcggcgagggccgcctcatggacctggatcccacgattggaggctccttgagcaggttctggaggcagttcatgaaggtgatcaagtgcaaaggtcagtgcttttcctcccctccctgtttcttcttggttcgattttgctttggattgggcgaacttttaggcattttattactggagcggcgctgtagatgaaattcttggattgtgttctttttagagttttcttgggtgaacattaccgatcttgcagaagctgtggagaaaagcatatctttttttttagtgaaaaatgtcattcaggattatgtttttttggtggattggtgggtgattttgctggatctgtgcagcggcggtggcaatgaactgcctccagaacctgctcaaggagcctccaatcgtgggatccaggtccatgaggcggccctcgccgctcaatctgacgatggttcgtggcgggagtcgccgatcaaacactgtcaaaaccgcatccggggcgtctacttctagcgcccagagtggcgcagtggaggcgggcacggagaaatccgatacgtacagcaccaacatgacgcaagctatgggagcagtgttgacgtatagacatgagcttggaatgaactacaatttcatacgcccagacttgatcgtgggctcctgcttacagagcccacttgatgttgataaacttagggacattggtgtaaaaacagtattctgcctgcagcaagatccagaccttgaatattttggagttgacatctgtgccattcaagaatattgtctacaatgtaaagatatagagcactgtcgtgccgaaattagggattttgatgcttttgatttgcgattgaggcttcctgctgtgattagcaaactgcacaagcttgtcaaccatacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 62 - DNA, 3547 bp, Artificial Sequence
  Synthetic construct OsUbi3P:OsDSP2 hpRNA
accgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatgcagatatttgataagcctgtcagaatgtcagcagtagccaatttaatggcttccaactttggaaagcaagctcgtttactctgtagtagctgatgcccttcattaagactgtagccaagaatccagaacatatacgccaatgtcacagcaggagctctcccaagtccagcggtacagtgtatatatgttaccccaccattatggttgacaagcttgtgcagtttgctaatcacagcaggaagcctcaatcgcaaatcaaaagcatcaaaatccctaatttcggcacgacagtgctctatatctttacattgtagacaatattcttgaatggcacagatgtcaactccaaaatattcaaggtctggatcttgctgcaggcagaatactgtttttacaccaatgtccctaagtttatcaacatcaagtgggctctgtaagcaggagcccacgatcaagaaggtgatcaagtgcaaaggtcagtgcttttcctcccctccctgtttcttcttggttcgattttgctttggattgggcgaacttttaggcattttattactggagcggcgctgtagatgaaattcttggattgtgttctttttagagttttcttgggtgaacattaccgatcttgcagaagctgtggagaaaagcatatctttttttttagtgaaaaatgtcattcaggattatgtttttttggtggattggtgggtgattttgctggatctgtgcagcggcggtggcattgatcgtgggctcctgcttacagagcccacttgatgttgataaacttagggacattggtgtaaaaacagtattctgcctgcagcaagatccagaccttgaatattttggagttgacatctgtgccattcaagaatattgtctacaatgtaaagatatagagcactgtcgtgccgaaattagggattttgatgcttttgatttgcgattgaggcttcctgctgtgattagcaaactgcacaagcttgtcaaccataatggtggggtaacatatatacactgtaccgctggacttgggagagctcctgctgtgacattggcgtatatgttctggattcttggctacagtcttaatgaagggcatcagctactacagagtaaacgagcttgctttccaaagttggaagccattaaattggctactgctgacattctgacaggcttatcaaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 63 - DNA, 3829 bp, Artificial Sequence
  Synthetic construct OsUbi3P:OsGWD1 hpRNA
accgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatgcagatatcagttcgtgctgcttcatactcctccttctcttgctcaggtgtatatgactgctttccctttctttcccaccgaagatatgattgtatctgcacaagatcctctggaaccacagtagaagaagtagcagtagatgtaccctgcccttgatattggctcgcttgtagctgaatttggaaattctggccattgtttttgtaccaattattccgtgcctcatcaaatatgaggaactcaatggcttgcactgcaggatcatctatctcaattttcagcgtggagttatcacctgactttataaaaggcgtcctaagagccctgttcttgtacactgtcgtgccatctggtttccgggatggtaggagccattctcctctatccgggcgaagggcgccccaatgcagtatcagggagccgctggtgttagttgcctctagattgatctccaccaccgaaccctgcggtgctgggttcaatgtcaccttaagctcggagttggcatccagggtgaaccttccgacaaggcccggggaggcgcggccggtggaagcggcgatggcgcgaggggcgaggaggctccgacgggagacgaaggtgatcaagtgcaaaggtcagtgcttttcctcccctccctgtttcttcttggttcgattttgctttggattgggcgaacttttaggcattttattactggagcggcgctgtagatgaaattcttggattgtgttctttttagagttttcttgggtgaacattaccgatcttgcagaagctgtggagaaaagcatatctttttttttagtgaaaaatgtcattcaggattatgtttttttggtggattggtgggtgattttgctggatctgtgcagcggcggtggcagtctcccgtcggagcctcctcgcccctcgcgccatcgccgcttccaccggccgcgcctccccgggccttgtcggaaggttcaccctggatgccaactccgagcttaaggtgacattgaacccagcaccgcagggttcggtggtggagatcaatctagaggcaactaacaccagcggctccctgatactgcattggggcgcccttcgcccggatagaggagaatggctcctaccatcccggaaaccagatggcacgacagtgtacaagaacagggctcttaggacgccttttataaagtcaggtgataactccacgctgaaaattgagatagatgatcctgcagtgcaagccattgagttcctcatatttgatgaggcacggaataattggtacaaaaacaatggccagaatttccaaattcagctacaagcgagccaatatcaagggcagggtacatctactgctacttcttctactgtggttccagaggatcttgtgcagatacaatcatatcttcggtgggaaagaaagggaaagcagtcatatacacctgagcaagagaaggaggagtatgaagcagcacgaactgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 64 - DNA, 3553 bp, Artificial Sequence
  Synthetic construct OsUbi3P:OsGWD2 hpRNA
accgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatgcagataattcttctgctgatattgcatattttccaagaaacttcttcttgactaatgacacagatggcactgcctggccagcttctgcatttagagaacctgattgcagttcactctctggaatctccctataggtgatatctgcagaagtaggtttgaaggaaaacactttcccatcatgtccttggagttcagacaaggtgttaggatcaaagcatgttgcaaataaaaccttgcaattccttgctcggactgatacatgggagagaacatctggcatatcaggtgtaataacaccaacaactccatctggtatttcttcctctcccttgacactctttgccacaaggatagttggtttatcataggatttgttttgaacagcaagcaattcatcaaccactacaatgtaacctgatacttcaactgggcttataacctgccaacttccaagctgtgaaggtgatcaagtgcaaaggtcagtgcttttcctcccctccctgtttcttcttggttcgattttgctttggattgggcgaacttttaggcattttattactggagcggcgctgtagatgaaattcttggattgtgttctttttagagttttcttgggtgaacattaccgatcttgcagaagctgtggagaaaagcatatctttttttttagtgaaaaatgtcattcaggattatgtttttttggtggattggtgggtgattttgctggatctgtgcagcggcggtggcaacagcttggaagttggcaggttataagcccagttgaagtatcaggttacattgtagtggttgatgaattgcttgctgttcaaaacaaatcctatgataaaccaactatccttgtggcaaagagtgtcaagggagaggaagaaataccagatggagttgttggtgttattacacctgatatgccagatgttctctcccatgtatcagtccgagcaaggaattgcaaggttttatttgcaacatgctttgatcctaacaccttgtctgaactccaaggacatgatgggaaagtgttttccttcaaacctacttctgcagatatcacctatagggagattccagagagtgaactgcaatcaggttctctaaatgcagaagctggccaggcagtgccatctgtgtcattagtcaagaagaagtttcttggaaaatatgcaatatcagcagaagaatcctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 65 - DNA, 3581 bp, Artificial Sequence
  Synthetic construct OsUbi3P: OsPWD1 hpRNA
accgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatgcagataaaagagttctgcatgcagcagcttttgcaccagctgattccactgaagcttctgaaagctcaagagcagcaaaactaccattcactcctgatttgcttttttgcttagacatttgcagtggcatctcgatatccgatggtagagagaattcattttggagtttctgttgaaatggattccctgtactatttggttctgtagagacagcattgtcatttttttctgaaactattgagagattgacattgatggatgatgcttctaatctgatatattttccctcaagcaaatacacatctgtaactgtgtcatcatattcacaagttacaaatacaacattctcttgacgagctctaacaccaagatgtgaaaggtgaggtagttcctgaagaagaataacaccaactatattatccccagcagctttgacctcttcatctccatcagccttatctacaattagaacgaaggtgatcaagtgcaaaggtcagtgcttttcctcccctccctgtttcttcttggttcgattttgctttggattgggcgaacttttaggcattttattactggagcggcgctgtagatgaaattcttggattgtgttctttttagagttttcttgggtgaacattaccgatcttgcagaagctgtggagaaaagcatatctttttttttagtgaaaaatgtcattcaggattatgtttttttggtggattggtgggtgattttgctggatctgtgcagcggcggtggcagttctaattgtagataaggctgatggagatgaagaggtcaaagctgctggggataatatagttggtgttattcttcttcaggaactacctcacctttcacatcttggtgttagagctcgtcaagagaatgttgtatttgtaacttgtgaatatgatgacacagttacagatgtgtatttgcttgagggaaaatatatcagattagaagcatcatccatcaatgtcaatctctcaatagtttcagaaaaaaatgacaatgctgtctctacagaaccaaatagtacagggaatccatttcaacagaaactccaaaatgaattctctctaccatcggatatcgagatgccactgcaaatgtctaagcaaaaaagcaaatcaggagtgaatggtagttttgctgctcttgagctttcagaagcttcagtggaatcagctggtgcaaaagctgctgcatgcagaactctttcctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 66 - DNA, 3549 bp, Artificial Sequence
  synthetic construct OsUbi3P:OsPWD2 hpRNA
accgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatgcagatatacttccttgccattgcccaccaaatttgcttgactcggcctctggtgctggatcaccattctcaacaactgaaatatcttgaactttttcaggtgcaaaagttacagatgctgaagcatcctcgccagtattcttttcagcttctccgaccaactcaaactttggtgttcctaaaagttctaatggctcttctgttctattccagtggcatactatatcaaacttaccatccttcggcagctcaacaacacggttattaccatcttcccatattttatcttttcctcccaccaaaaatataacaaatttaaactccacaagtgtttctccagggagcttaagctggcagacccaaccatttgtagtccattccagttcaacctgctcctcccatgaaccaagctcctttgtggaaccgataatgcctacatgctcaccaaacttaacctgaaggtgatcaagtgcaaaggtcagtgcttttcctcccctccctgtttcttcttggttcgattttgctttggattgggcgaacttttaggcattttattactggagcggcgctgtagatgaaattcttggattgtgttctttttagagttttcttgggtgaacattaccgatcttgcagaagctgtggagaaaagcatatctttttttttagtgaaaaatgtcattcaggattatgtttttttggtggattggtgggtgattttgctggatctgtgcagcggcggtggcaaggttaagtttggtgagcatgtaggcattatcggttccacaaaggagcttggttcatgggaggagcaggttgaactggaatggactacaaatggttgggtctgccagcttaagctccctggagaaacacttgtggagtttaaatttgttatatttttggtgggaggaaaagataaaatatgggaagatggtaataaccgtgttgttgagctgccgaaggatggtaagtttgatatagtatgccactggaatagaacagaagagccattagaacttttaggaacaccaaagtttgagttggtcggagaagctgaaaagaatactggcgaggatgcttcagcatctgtaacttttgcacctgaaaaagttcaagatatttcagttgttgagaatggtgatccagcaccagaggccgagtcaagcaaatttggtgggcaatggcaaggaagtacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 67 - DNA, 2827 bp, Artificial Sequence
  Synthetic construct OsUbi3P:SbGWD RNAi
atcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgagagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagggatccaccgggagtgagataagcaaagcacaagataggtttacagatgatcttgagaatatgtacagaacttatcctcagtacagagagatactaagaatgataatggctgctgttggtcgtggaggtgaaggtgacgttggtcaacgcattcgtgatgagatattagtaatacaggtaaaactgatggtccttggtgaatatacagttattttcgttcattgctctgctgaattgagcagttggtagtgctcatccaaaacgtagacattgtcaacaataaaatgtttggtgtgttacagagaaataccgggctgtattactaatatctcatcacgaatgcgttgaccaacgtcaccttcacctccacgaccaacagcagccattatcattcttagtatctctctgtactgaggataagttctgtacatattctcaagatcatctgtaaacctatcttgtgctttgcttatctcactgctagctccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 68 - DNA, 2599 bp, Artificial Sequence
  Synthetic construct ZmPepCP:SbGWD1 RNAi
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctgcttcaggtgtttttgtcaatttagctcgaagcttctctaaagaaacacctctatttaattcctctattaactcagctcgtgcagcttcatactcctccttttcttgctctggtgtgtatgactgctttccctttctttcccaccgaaggtaagcttggatctgcacaagatcctctggcaccaaggtagaagtagcagaagaggaggcaccagatgcaccattaccctgatggcggctcgactggagctgaatctgaaaattctggccattgtttttaaaccatttgttctgtgtctcgccaaagatgaggaactcaatagcttgcaccgcaggatcatctatctcaattctaagagtagagttatcaccagactttacaaaaggcgtcctaagagccctgttcttgtacaccgtcgttccatcaggttgtctggatgggaggatgggaggccaaggtatctaatcagccatcccacatttgggtcttgtcagtagatatgatgcagcaactcgcggttgacttgcgctttcttggcggcttatctgtcttaggggcagactcctcctcccatccagacaacctgatggaacgacggtgtacaagaacagggctcttaggacgccttttgtaaagtctggtgataactctactcttagaattgagatagatgatcctgcggtgcaagctattgagttcctcatctttggcgagacacagaacaaatggtttaaaaacaatggccagaattttcagattcagctccagtcgagccgccatcagggtaatggtgcatctggtgcctcctcttctgctacttctaccttggtgccagaggatcttgtgcagatccaagcttaccttcggtgggaaagaaagggaaagcagtcatacacaccagagcaagaaaaggaggagtatgaagctgcacgagctgagttaatagaggaattaaatagaggtgtttctttagagaagcttcgagctaaattgacaaaaacacctgaagcacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 69 - DNA, 2787 bp, Artificial Sequence
  Synthetic construct ZmPepCP: SbGWD2 RNAi
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatccgaggtatgctatattccgagacttggccccaaccatttcctcggtgaattcttcagctgatattgcatattttccaagaaatttcttcttggccaatgaaatagatggtactgcatggccaacttctgcatttggagaacttgattgctgaagctcactctctgtgatctccctataggttatatctgcagaagtaggcttgaaggaaagcagtttctgatcatatccttcaagttcagacagagtggtatggtcaaaacaggttgcaaacagtaccttgctattccttgctcggactgacacatgggacagaacatctggcatatcaggtgtaattacaccaactactccatctggtatttcttcctctcccttgacactctttgccacaaggatggttggtttatcataagatttgttctggacagcaagtaactcatcaaccacaaccacataacctgatacttcaactgggcttataacctgccaacttccaaggttagcaacgttccttagaacaggatcaaatcggttcagaagtgggaggccaaggtatctaatcagccatcccacatttgggtcttgtcagtagatatgatgcagcaactcgcggttgacttgcgctttcttggcggcttatctgtcttaggggcagactcccttctgaaccgatttgatcctgttctaaggaacgttgctaaccttggaagttggcaggttataagcccagttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtcccatgtgtcagtccgagcaaggaatagcaaggtactgtttgcaacctgttttgaccataccactctgtctgaacttgaaggatatgatcagaaactgctttccttcaagcctacttctgcagatataacctatagggagatcacagagagtgagcttcagcaatcaagttctccaaatgcagaagttggccatgcagtaccatctatttcattggccaagaagaaatttcttggaaaatatgcaatatcagctgaagaattcaccgaggaaatggttggggccaagtctcggaatatagcatacctccctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 70 - DNA, 2944 bp, Artificial Sequence
  Synthetic construct ZmPepCP:ZmGWD1 RNAi
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctttaccgatgggcactcgagatgcagaagatttactttcatccgactcgggtgcttcaggtgcttttgtcaatttagctcgaagcttctctaaagaaacacctctgtttacttcctctattaactcagctcgtgcagcttcatactcctccttttcttgctctggtgtgtatgactgctttccccttctttcccaccgaaggtaagcttggatctgcacaagatcctctggcaccaaggtagaagtagcagaagaggaggcaccagatgcaccagtaccctgatggcggctcgactggaactgaacctgaaaattctggccattgtttttaaaccatttgttctgtgtctcgtcaaagatgaggaactcaatggcgtgcaccccaggatcatctatctcaatccttagagtggagttatcacctgactttacaaaaggtgtcctgagagccctgttcttgtacactgtcgttccatcaggttttctggacgggaggaattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagtttcctcccgtccagaaaacctgatggaacgacagtgtacaagaacagggctctcaggacaccttttgtaaagtcaggtgataactccactctaaggattgagatagatgatcctggggtgcacgccattgagttcctcatctttgacgagacacagaacaaatggtttaaaaacaatggccagaattttcaggttcagttccagtcgagccgccatcagggtactggtgcatctggtgcctcctcttctgctacttctaccttggtgccagaggatcttgtgcagatccaagcttaccttcggtgggaaagaaggggaaagcagtcatacacaccagagcaagaaaaggaggagtatgaagctgcacgagctgagttaatagaggaagtaaacagaggtgtttctttagagaagcttcgagctaaattgacaaaagcacctgaagcacccgagtcggatgaaagtaaatcttctgcatctcgagtgcccatcggtaaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 71 - DNA, 3030 bp, Artificial Sequence
  Synthetic construct ZmPepCP:ZmGWD2 RNAi
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatccgaggtatgctatattccgagacttggccccaaccatttcctcagagaattcttcggctgatattgcatattttccaagaaatttcttcttggccaatgaaatagatggtactgcatggccaacttctgcatttggagaacttgattgctgaagttcactctctgtgatctccctataggttatatctgcagaagtaggcttgaaggaaaacagtttctgatcatatccttcaagttcagatagagtggtgtggtcaaaacaggtcgcaaacagtaccttgctattccttgctcggactgacacatgagacagaacatctggcatatcaggtgtaattacaccaactactccatctggtatttcttcctctcccttgacactctttgccacaaggatggttggtttatcataagatttgttctggacagcaagtaactcatcaaccacaaccacataacctgatacttcaaccgggcttataacctgccaacttccgaggtgagcaacattccttaaaacaggatcaaatcggttcagaagattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagttcttctgaaccgatttgatcctgttttaaggaatgttgctcacctcggaagttggcaggttataagcccggttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtctcatgtgtcagtccgagcaaggaatagcaaggtactgtttgcgacctgttttgaccacaccactctatctgaacttgaaggatatgatcagaaactgttttccttcaagcctacttctgcagatataacctatagggagatcacagagagtgaacttcagcaatcaagttctccaaatgcagaagttggccatgcagtaccatctatttcattggccaagaagaaatttcttggaaaatatgcaatatcagccgaagaattctctgaggaaatggttggggccaagtctcggaatatagcatacctccctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 72 - DNA, 7281 bp, Artificial Sequence
  Synthetic construct OsDSP1 and OsGWD2
accgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatgcagatatatggttgacaagcttgtgcagtttgctaatcacagcaggaagcctcaatcgcaaatcaaaagcatcaaaatccctaatttcggcacgacagtgctctatatctttacattgtagacaatattcttgaatggcacagatgtcaactccaaaatattcaaggtctggatcttgctgcaggcagaatactgtttttacaccaatgtccctaagtttatcaacatcaagtgggctctgtaagcaggagcccacgatcaagtctgggcgtatgaaattgtagttcattccaagctcatgtctatacgtcaacactgctcccatagcttgcgtcatgttggtgctgtacgtatcggatttctccgtgcccgcctccactgcgccactctgggcgctagaagtagacgccccggatgcggttttgacagtgtttgatcggcgactcccgccacgaaccatcgtcagattgagcggcgagggccgcctcatggacctggatcccacgattggaggctccttgagcaggttctggaggcagttcatgaaggtgatcaagtgcaaaggtcagtgcttttcctcccctccctgtttcttcttggttcgattttgctttggattgggcgaacttttaggcattttattactggagcggcgctgtagatgaaattcttggattgtgttctttttagagttttcttgggtgaacattaccgatcttgcagaagctgtggagaaaagcatatctttttttttagtgaaaaatgtcattcaggattatgtttttttggtggattggtgggtgattttgctggatctgtgcagcggcggtggcaatgaactgcctccagaacctgctcaaggagcctccaatcgtgggatccaggtccatgaggcggccctcgccgctcaatctgacgatggttcgtggcgggagtcgccgatcaaacactgtcaaaaccgcatccggggcgtctacttctagcgcccagagtggcgcagtggaggcgggcacggagaaatccgatacgtacagcaccaacatgacgcaagctatgggagcagtgttgacgtatagacatgagcttggaatgaactacaatttcatacgcccagacttgatcgtgggctcctgcttacagagcccacttgatgttgataaacttagggacattggtgtaaaaacagtattctgcctgcagcaagatccagaccttgaatattttggagttgacatctgtgccattcaagaatattgtctacaatgtaaagatatagagcactgtcgtgccgaaattagggattttgatgcttttgatttgcgattgaggcttcctgctgtgattagcaaactgcacaagcttgtcaaccatacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatgcagataattcttctgctgatattgcatattttccaagaaacttcttcttgactaatgacacagatggcactgcctggccagcttctgcatttagagaacctgattgcagttcactctctggaatctccctataggtgatatctgcagaagtaggtttgaaggaaaacactttcccatcatgtccttggagttcagacaaggtgttaggatcaaagcatgttgcaaataaaaccttgcaattccttgctcggactgatacatgggagagaacatctggcatatcaggtgtaataacaccaacaactccatctggtatttcttcctctcccttgacactctttgccacaaggatagttggtttatcataggatttgttttgaacagcaagcaattcatcaaccactacaatgtaacctgatacttcaactgggcttataacctgccaacttccaagctgtgaaggtgatcaagtgcaaaggtcagtgcttttcctcccctccctgtttcttcttggttcgattttgctttggattgggcgaacttttaggcattttattactggagcggcgctgtagatgaaattcttggattgtgttctttttagagttttcttgggtgaacattaccgatcttgcagaagctgtggagaaaagcatatctttttttttagtgaaaaatgtcattcaggattatgtttttttggtggattggtgggtgattttgctggatctgtgcagcggcggtggcaacagcttggaagttggcaggttataagcccagttgaagtatcaggttacattgtagtggttgatgaattgcttgctgttcaaaacaaatcctatgataaaccaactatccttgtggcaaagagtgtcaagggagaggaagaaataccagatggagttgttggtgttattacacctgatatgccagatgttctctcccatgtatcagtccgagcaaggaattgcaaggttttatttgcaacatgctttgatcctaacaccttgtctgaactccaaggacatgatgggaaagtgttttccttcaaacctacttctgcagatatcacctatagggagattccagagagtgaactgcaatcaggttctctaaatgcagaagctggccaggcagtgccatctgtgtcattagtcaagaagaagtttcttggaaaatatgcaatatcagcagaagaatcctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 73 - DNA, 7381 bp, Artificial Sequence
  Synthetic construct OsPWD2 and OsGWD1
accgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatgcagatatacttccttgccattgcccaccaaatttgcttgactcggcctctggtgctggatcaccattctcaacaactgaaatatcttgaactttttcaggtgcaaaagttacagatgctgaagcatcctcgccagtattcttttcagcttctccgaccaactcaaactttggtgttcctaaaagttctaatggctcttctgttctattccagtggcatactatatcaaacttaccatccttcggcagctcaacaacacggttattaccatcttcccatattttatcttttcctcccaccaaaaatataacaaatttaaactccacaagtgtttctccagggagcttaagctggcagacccaaccatttgtagtccattccagttcaacctgctcctcccatgaaccaagctcctttgtggaaccgataatgcctacatgctcaccaaacttaacctgaaggtgatcaagtgcaaaggtcagtgcttttcctcccctccctgtttcttcttggttcgattttgctttggattgggcgaacttttaggcattttattactggagcggcgctgtagatgaaattcttggattgtgttctttttagagttttcttgggtgaacattaccgatcttgcagaagctgtggagaaaagcatatctttttttttagtgaaaaatgtcattcaggattatgtttttttggtggattggtgggtgattttgctggatctgtgcagcggcggtggcaaggttaagtttggtgagcatgtaggcattatcggttccacaaaggagcttggttcatgggaggagcaggttgaactggaatggactacaaatggttgggtctgccagcttaagctccctggagaaacacttgtggagtttaaatttgttatatttttggtgggaggaaaagataaaatatgggaagatggtaataaccgtgttgttgagctgccgaaggatggtaagtttgatatagtatgccactggaatagaacagaagagccattagaacttttaggaacaccaaagtttgagttggtcggagaagctgaaaagaatactggcgaggatgcttcagcatctgtaacttttgcacctgaaaaagttcaagatatttcagttgttgagaatggtgatccagcaccagaggccgagtcaagcaaatttggtgggcaatggcaaggaagtacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatgcagatatcagttcgtgctgcttcatactcctccttctcttgctcaggtgtatatgactgctttccctttctttcccaccgaagatatgattgtatctgcacaagatcctctggaaccacagtagaagaagtagcagtagatgtaccctgcccttgatattggctcgcttgtagctgaatttggaaattctggccattgtttttgtaccaattattccgtgcctcatcaaatatgaggaactcaatggcttgcactgcaggatcatctatctcaattttcagcgtggagttatcacctgactttataaaaggcgtcctaagagccctgttcttgtacactgtcgtgccatctggtttccgggatggtaggagccattctcctctatccgggcgaagggcgccccaatgcagtatcagggagccgctggtgttagttgcctctagattgatctccaccaccgaaccctgcggtgctgggttcaatgtcaccttaagctcggagttggcatccagggtgaaccttccgacaaggcccggggaggcgcggccggtggaagcggcgatggcgcgaggggcgaggaggctccgacgggagacgaaggtgatcaagtgcaaaggtcagtgcttttcctcccctccctgtttcttcttggttcgattttgctttggattgggcgaacttttaggcattttattactggagcggcgctgtagatgaaattcttggattgtgttctttttagagttttcttgggtgaacattaccgatcttgcagaagctgtggagaaaagcatatctttttttttagtgaaaaatgtcattcaggattatgtttttttggtggattggtgggtgattttgctggatctgtgcagcggcggtggcagtctcccgtcggagcctcctcgcccctcgcgccatcgccgcttccaccggccgcgcctccccgggccttgtcggaaggttcaccctggatgccaactccgagcttaaggtgacattgaacccagcaccgcagggttcggtggtggagatcaatctagaggcaactaacaccagcggctccctgatactgcattggggcgcccttcgcccggatagaggagaatggctcctaccatcccggaaaccagatggcacgacagtgtacaagaacagggctcttaggacgccttttataaagtcaggtgataactccacgctgaaaattgagatagatgatcctgcagtgcaagccattgagttcctcatatttgatgaggcacggaataattggtacaaaaacaatggccagaatttccaaattcagctacaagcgagccaatatcaagggcagggtacatctactgctacttcttctactgtggttccagaggatcttgtgcagatacaatcatatcttcggtgggaaagaaagggaaagcagtcatatacacctgagcaagagaaggaggagtatgaagcagcacgaactgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 74 - DNA, 7131 bp, Artificial Sequence
  Synthetic construct OsDSP2 and OsPWD1
accgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatgcagatatttgataagcctgtcagaatgtcagcagtagccaatttaatggcttccaactttggaaagcaagctcgtttactctgtagtagctgatgcccttcattaagactgtagccaagaatccagaacatatacgccaatgtcacagcaggagctctcccaagtccagcggtacagtgtatatatgttaccccaccattatggttgacaagcttgtgcagtttgctaatcacagcaggaagcctcaatcgcaaatcaaaagcatcaaaatccctaatttcggcacgacagtgctctatatctttacattgtagacaatattcttgaatggcacagatgtcaactccaaaatattcaaggtctggatcttgctgcaggcagaatactgtttttacaccaatgtccctaagtttatcaacatcaagtgggctctgtaagcaggagcccacgatcaagaaggtgatcaagtgcaaaggtcagtgcttttcctcccctccctgtttcttcttggttcgattttgctttggattgggcgaacttttaggcattttattactggagcggcgctgtagatgaaattcttggattgtgttctttttagagttttcttgggtgaacattaccgatcttgcagaagctgtggagaaaagcatatctttttttttagtgaaaaatgtcattcaggattatgtttttttggtggattggtgggtgattttgctggatctgtgcagcggcggtggcattgatcgtgggctcctgcttacagagcccacttgatgttgataaacttagggacattggtgtaaaaacagtattctgcctgcagcaagatccagaccttgaatattttggagttgacatctgtgccattcaagaatattgtctacaatgtaaagatatagagcactgtcgtgccgaaattagggattttgatgcttttgatttgcgattgaggcttcctgctgtgattagcaaactgcacaagcttgtcaaccataatggtggggtaacatatatacactgtaccgctggacttgggagagctcctgctgtgacattggcgtatatgttctggattcttggctacagtcttaatgaagggcatcagctactacagagtaaacgagcttgctttccaaagttggaagccattaaattggctactgctgacattctgacaggcttatcaaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatgcagataaaagagttctgcatgcagcagcttttgcaccagctgattccactgaagcttctgaaagctcaagagcagcaaaactaccattcactcctgatttgcttttttgcttagacatttgcagtggcatctcgatatccgatggtagagagaattcattttggagtttctgttgaaatggattccctgtactatttggttctgtagagacagcattgtcatttttttctgaaactattgagagattgacattgatggatgatgcttctaatctgatatattttccctcaagcaaatacacatctgtaactgtgtcatcatattcacaagttacaaatacaacattctcttgacgagctctaacaccaagatgtgaaaggtgaggtagttcctgaagaagaataacaccaactatattatccccagcagctttgacctcttcatctccatcagccttatctacaattagaacgaaggtgatcaagtgcaaaggtcagtgcttttcctcccctccctgtttcttcttggttcgattttgctttggattgggcgaacttttaggcattttattactggagcggcgctgtagatgaaattcttggattgtgttctttttagagttttcttgggtgaacattaccgatcttgcagaagctgtggagaaaagcatatctttttttttagtgaaaaatgtcattcaggattatgtttttttggtggattggtgggtgattttgctggatctgtgcagcggcggtggcagttctaattgtagataaggctgatggagatgaagaggtcaaagctgctggggataatatagttggtgttattcttcttcaggaactacctcacctttcacatcttggtgttagagctcgtcaagagaatgttgtatttgtaacttgtgaatatgatgacacagttacagatgtgtatttgcttgagggaaaatatatcagattagaagcatcatccatcaatgtcaatctctcaatagtttcagaaaaaaatgacaatgctgtctctacagaaccaaatagtacagggaatccatttcaacagaaactccaaaatgaattctctctaccatcggatatcgagatgccactgcaaatgtctaagcaaaaaagcaaatcaggagtgaatggtagttttgctgctcttgagctttcagaagcttcagtggaatcagctggtgcaaaagctgctgcatgcagaactctttcctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 75 - DNA, 12310 bp, Artificial Sequence
  synthetic construct, vector pAG2005
aattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctctccagatccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagcccgggtattcatcctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgg

SEQ ID NO: 76 - DNA, 10161 bp, Artificial Sequence
  Synthetic construct, vector pAG4003
taagtctaactcgagttactggtacgtaccaaatccatggaatcaaggtaccatcaatcccgggtattcatcctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatctaaaccatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaat

SEQ ID NO: 77 - protein, 207 aa, Thermomyces lanuginosus
  MISC_FEATURE (1)..(207): O43097 protein
MFPAGNATELEKRQTTPNSEGWHDGYYYSWWSDGGAQATYTNLEGGTYEISWGDGGNLVGGKGWNPGLNARAIHFEGVYQPNGNSYLAVYGWTRNPLVEYYIVENFGTYDPSSGATDLGTVECDGSIYRLGKTTRVNAPSIDGTQTFDQYWSVRQDKRTSGTVQTGCHFDAWARAGLNVNGDHYYQIVATEGYFSSGYARITVADVG

SEQ ID NO: 78 - protein, 505 aa, Penicillium funiculosum
  MISC_FEATURE (1)..(505): BD22308 protein
MQQIGTYTAETHPSLSWSTCKSGGSCTTNSGAITLDANWRWVHGVNTSTNCYTGNTWNTAICDTDASCAQDCALDGADYSGTYGITTSGNSLRLNFVTGSNVGSRTYLMADNTHYQIFDLLNQEFTFTVDVSHLPCGLNGALYFVTMDADGGVSKYPNNKAGAQYGVGYCDSQCPRDLKFIAGQANVEGWTPSSNNANTGLGNHGACCAELDIWEANSISEALTPHPCDTPGLSVCTTDACGGTYSSDRYAGTCDPDGCDFNPYRLGVTDFYGSGKTVDTTKPITVVTQFVTDDGTSTGTLSEIRRYYVQNGVVIPQPSSKISGVSGNVINSDFCDAEISTFGETASFSKHGGLAKMGAGMEAGMVLVMSLWDDYSVNMLWLDSTYPTNATGTPGAARGSCPTTSGDPKTVESQSGSSYVTFSDIRVGPFNSTFSGGSSTGGSSTTTASGTTTTKASSTSTSSTSTGTGVAAHWGQCGGQGWTGPTTCASGTTCTVVNPYYSQCL

SEQ ID NO: 79 - protein, 367 aa, Artificial Sequence
  Synthetic construct BD25243 protein
MQNAAWAQCGGNGWTGSKTCVSGYKCTVVNEWYSQCIPGTAEEPTTTLKTTTGGGSTPTGTPGNGKFLWVGTNEAGGEFGEGSLPGTWGKHFIFPDPAAVDTLISQGYNAFRVQLRMERTNPSSMTGPFDTAYLKNLTTIVDHITGKGANVILDPHNYGRYFDKIITSTSDFQTWWKNFATQFKSNSKVIFDTNNEYNTMDQTLVLNLNQAAINGIRAAGATQTIFVEGNQWSGAWSWPDVNDNMKALTDPLDKIVYEMHQYLDSDSSGTSPNCVSTTIGVERVKAATEWLRKNKKIGMIGELAGGPNDTCKTAVKNMLDYLKENSDVWKGVTWWAAGPWWADYMFSFEPPSGTGYQYYNSLLKTYI

SEQ ID NO: 80 - protein, 194 aa, Artificial Sequence
  Synthetic construct EU591743 protein
MAQTCLTSPQTGFHNGFFYSFWKDSPGTVNFCLLEGGRYTSNWSGINNWVGGKGWQTGSRRNITYSGSFNTPGNGYLALYGWTTNPLVEYYVVDSWGSWRPPGSDGTFLGTVNSDGGTYDIYRAQRVNAPSIIGNATFYQYWSVRQSKRVGGTITTGNHFDAWASVGLNLGTHNYQIMATEGYQSSGSSDITVS

SEQ ID NO: 81 - protein, 433 aa, Nasutitermes takasagoensis
  MISC_FEATURE (1)..(433): NtEGm protein
MAYDYKQVLRDSLLFYEAQRSGRLPADQKVTWRKDSALNDQGDQGQDLTGGYFDAGDFVKFGFPMAYTATVLAWGLIDFEAGYSSAGALDDGRKAVKWATDYFIKAHTSQNEFYGQVGQGDADHAFWGRPEDMTMARPAYKIDTSRPGSDLAGETAAALAAASIVFRNVDGTYSNNLLTHARQLFDFANNYRGKYSDSITDARNFYASADYRDELVWAAAWLYRATNDNTYLNTAESLYDEFGLQNWGGGLNWDSKVSGVQVLLAKLTNKQAYKDTVQSYVNYLINNQQKTPKGLLYIDMWGTLRHAANAAFIMLEAAELGLSASSYRQFAQTQIDYALGDGGRSFVCGFGSNPPTRPHHRSSSCPPAPATCDWNTFNSPDPNYHVLSGALVGGPDQNDNYVDDRSDYVHNEVATDYNAGFQSALAALVALGY

SEQ ID NO: 82 - protein, 792 aa, Clostridium thermocellum
  MISC_FEATURE (1)..(792): P0C2S1 protein
MLEDKSSKLPDYKNDLLYERTFDEGLCFPWHTCEDSGGKCDFAVVDVPGEPGNKAFRLTVIDKGQNKWSVQMRHRGITLEQGHTYTVRFTIWSDKSCRVYAKIGQMGEPYTEYWNNNWNPFNLTPGQKLTVEQNFTMNYPTDDTCEFTFHLGGELAAGTPYYVYLDDVSLYDPRFVKPVEYVLPQPDVRVNQVGYLPFAKKYATVVSSSTSPLKWQLLNSANQVVLEGNTIPKGLDKDSQDYVHWIDFSNFKTEGKGYYFKLPTVNSDTNYSHPFDISADIYSKMKFDALAFFYHKRSGIPIEMPYAGGEQWTRPAGHIGIEPNKGDTNVPTWPQDDEYAGRPQKYYTKDVTGGWYDAGDHGKYVVNGGIAVWTLMNMYERAKIRGIANQGAYKDGGMNIPERNNGYPDILDEARWEIEFFKKMQVTEKEDPSIAGMVHHKIHDFRWTALGMLPHEDPQPRYLRPVSTAATLNFAATLAQSARLWKDYDPTFAADCLEKAEIAWQAALKHPDIYAEYTPGSGGPGGGPYNDDYVGDEFYWAACELYVTTGKDEYKNYLMNSPHYLEMPAKMGENGGANGEDNGLWGCFTWGTTQGLGTITLALVENGLPATDIQKARNNIAKAADRWLENIEEQGYRLPIKQAEDERGGYPWGSNSFILNQMIVMGYAYDFTGNSKYLDGMQDGMSYLLGRNGLDQSYVTGYGERPLQNPHDRFWTPQTSKKFPAPPPGIIAGGPNSRFEDPTITAAVKKDTPPQKCYIDHTDSWSTNEITVNWNAPFAWVTAYLDEIDLIG

SEQ ID NO: 83 - protein, 337 aa, Dictyoglomus thermophilum
  MISC_FEATURE (1)..(337): P77853 protein
MQTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGATSLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 84 - protein, 869 aa, Clostridium thermocellum
  MISC_FEATURE (1)..(869): O68438 protein
MLEDKSPKLPDYKNDLLYERTFDEGLCFPWHTCEDSGGKCDFAVVDVPGEPGNKAFRLTVIDKGQNKWSVQMRHRGITLEQGHTYTVRFTIWSDKSCRVYAKIGQMGEPYTEYWNNNWNPFNLTPGQKLTVEQNFTMNYPTDDTCEFTFHLGGELAAGTPYYVYLDDVSLYDPRFVKPVEYVLPQPDVRVNQVGYLPFAKKYATVVSSSTSPLKWQLLNSANQVVLEGNTIPKGLDKDSQDYVHWIDFSNFKTEGKGYYFKLPTVNSDTNYSHPFDISADIYSKMKFDALAFFYHKRSGIPIEMPYAGGEQWTRPAGHIGVAPNKGDTNVPTWPQDDEYAGRPQKYYTKDVTGGWYDAGDHGKYVVNGGIAVWTLMNMYERAKIRGIANQGAYKDGGMNIPERNNGYPDILDEARWEIEFFKKMQVTEKEDPSIAGMVHHKIHDFRWTALGMLPHEDPQPRYLRPVSTAATLNFAATLAQSARLWKDYDPTFAADCLEKAEIAWQAALKHPDIYAEYTPGSGGPGGGPYNDDYVGDEFYWAACELYVTTGKDEYKNYLMNSPHYLEMPAKMGENGGANGEDNGLWGCFTWGTTQGLGTITLALVENGLPSADIQKARNNIAKAADKWLENIEEQGYRLPIKQAEDERGGYPWGSNSFILNQMIVMGYAYDFTGNSKYLDGMQDGMSYLLGRNGLDQSYVTGYGERPLQNPHDRFWTPQTSKKFPAPPPGIIAGGPNSRFEDPTITAAVKKDTPPQKCYIDHTDSWSTNEITINWNAPFAWVTAYLDEIDLITPPGGVDPEEPEVIYGDCNGDGKVNSTDAVALKRYILRSGISINTDNADVNADGRVNSTDLAILKRYILKEIDVLPHK

SEQ ID NO: 85 - protein, 243 aa, Rhodothermus marinus
  MISC_FEATURE (1)..(243): O33897 protein
CDWLFPDGDNGKEPEPEPEPTVELCGRWDARDVAGGRYRVINNVWGAETAQCIEVGLETGNFTITRADHDNGNNVAAYPAIYFGCHWAPARAIRDCAARAGAVRRAHELDVTPITTGRWNAAYDIWFSPVTNSGNGYSGGAELMIWLNWNGGVMPGGSRVATVELAGATWEVWYADWDWNYIAYRRTTPTTSVSELDLKAFIDDAVARGYIRPEWYLHAVETGFELWEGGAGLRTADFSVTVQ

SEQ ID NO: 86 - DNA, 621 bp, Thermomyces lanuginosus
  misc_feature (1)..(621): O43097 coding sequence
ttcccagctggaaacgcaacggaattggagaaaagacaaaccacccctaactctgagggctggcatgacggatactactactcttggtggagcgatggtggtgcacaggccacctatacaaacctcgaaggcggcacttatgagatttcatggggtgacggtggcaaccttgtcggcggaaaggggtggaaccccggacttaacgccagggcaatccacttcgaaggggtgtaccagcccaatggcaactcatacctggccgtctacgggtggacgcgcaatccgctggttgagtactatatcgtggagaatttcggaacttatgaccctagctccggtgccacggacctcgggacagtcgagtgtgacggaagcatctacaggctgggtaaaactacccgcgttaatgctccatcgatcgacggcacgcaaacatttgatcaatactggtccgtgcggcaggataagaggacaagcggcacagttcagacgggttgccactttgatgcctgggcaagagcggggctcaatgtgaatggggaccactactatcagattgtggcgaccgagggctatttctccagtggctatgcgcgtataaccgtcgctgatgttggatga

SEQ ID NO: 87 - DNA, 1515 bp, Penicillium funiculosum
  misc_feature (1)..(1515): BD22308 coding sequence
cagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctgtga

SEQ ID NO: 88 - DNA, 1104 bp, Artificial Sequence
  Synthetic construct BD25243 coding sequence
atgcaaaacgcagcatgggcccaatgcggtggaaacggctggactggctcaaagacctgcgtctctggctacaagtgtaccgtcgttaatgagtggtacagccagtgcatccccggcactgctgaggaacctactaccaccctcaagactactactggtggtggtagcacacctactggtacacctggaaatggaaagtttctctgggttggtactaatgaggctggtggtgagtttggtgagggcagtttgcctggaacttggggaaagcacttcatcttccctgatcccgctgccgttgataccctcatctctcagggctacaacgccttccgcgttcaactccgcatggaacgcacaaaccctagctccatgaccggaccctttgacaccgcttacttgaagaacctcaccacaatcgtggaccacatcaccggcaagggcgccaacgtcattctcgaccctcacaactacggccgctactttgacaagattatcacttcaacctctgacttccagacctggtggaagaactttgctacccagttcaagagcaacagcaaggtcatctttgacactaacaatgagtacaacaccatggatcagactcttgttctgaacttgaaccaggctgctatcaacggtattcgtgctgctggcgctacccagactatctttgttgagggtaaccagtggtctggtgcttggtcttggcccgatgtcaacgacaacatgaaggctcttaccgaccctcttgacaagatcgtatacgaaatgcaccagtacctcgactctgacagctccggtacttcacctaactgtgtctccaccaccattggagtcgagcgcgtcaaggctgctactgagtggttgaggaagaacaagaagattggcatgatcggtgaactcgccggcggtcctaacgatacctgcaagactgctgtcaagaacatgctggactatcttaaggagaactctgatgtttggaagggtgttacctggtgggctgctggtccttggtgggctgactacatgttcagctttgagcctcccagcggtactggttatcagtactacaactctcttctcaagacttatatctaa

SEQ ID NO: 89 - DNA, 585 bp, Artificial Sequence
  Synthetic construct EU591743 coding sequence
atggcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcatga

SEQ ID NO: 90 - DNA, 1299 bp, Nasutitermes takasagoensis
  misc_feature (1)..(1299): NtEGm coding sequence
gcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttactga

SEQ ID NO: 91 - DNA, 2376 bp, Clostridium thermocellum
  misc_feature (1)..(2376): P0C2S1 coding sequence
atgctggaggacaagtccagcaagctccctgactacaagaacgatctcctgtacgagcggacgttcgacgagggcctctgcttcccgtggcacacatgcgaggattcgggcggcaagtgcgacttcgctgtggtcgatgtgccaggcgagccaggcaacaaggcgttccgcctcacggtcatcgacaagggccagaacaagtggtctgtgcagatgcgccacaggggcatcacactggagcagggccatacgtacacagtcaggttcaccatctggagcgacaagtcgtgccgggtgtacgccaagatcggccagatgggcgagccgtacaccgagtactggaacaacaactggaaccctttcaacctcaccccgggccagaagctgacggtggagcagaacttcaccatgaactaccccacggacgatacatgcgagttcaccttccacctcggcggcgagctggctgctggcacgccatactacgtctacctcgacgatgtgtccctgtacgatcccaggttcgtgaagccagtcgagtatgtgctcccccagccagacgtgcgggtcaaccaggtcggctacctgcccttcgccaagaagtacgcgaccgtggtctcgtcttccacgtctccactgaagtggcagctcctgaactccgccaaccaggtggtcctggagggcaacacgatccccaagggcctcgacaaggatagccaggactacgtgcactggatcgatttctcgaacttcaagaccgagggcaagggctactacttcaagctccctacggtcaactctgacacaaactactcccacccgttcgacatcagcgcggatatctactcgaagatgaagttcgacgccctggcgttcttctaccataagcgcagcggcatccccatcgagatgccatacgccggcggcgagcagtggacgaggcctgctggccacatcggcatcgagccgaacaagggcgacacgaacgtccctacatggccacaggacgatgagtacgctggccgcccgcagaagtactacaccaaggacgtgacgggcggctggtacgacgctggcgaccacggcaagtatgtggtcaacggcggcatcgccgtctggaccctcatgaacatgtacgagagggcgaagatccggggcatcgctaaccagggcgcttacaaggacggcggcatgaacatccccgagaggaacaacggctacccagacatcctggatgaggcccgctgggagatcgagttcttcaagaagatgcaggtcaccgagaaggaggacccgtccatcgccggcatggtgcaccataagatccacgatttcaggtggacggctctcggcatgctgccacatgaggaccctcagccacgctacctcaggccggtgtccaccgctgctacgctcaacttcgctgctacgctggctcagtctgctaggctctggaaggactacgatccgacattcgccgcggattgcctggagaaggctgagatcgcttggcaggctgctctcaagcacccagacatctacgccgagtacaccccaggcagcggcggccctggcggcggcccgtacaacgacgattacgtcggcgatgagttctactgggctgcttgcgagctctacgtgaccacgggcaaggacgagtacaagaactacctgatgaactcgcctcattacctggagatgccagctaagatgggcgagaacggcggcgctaacggcgaggacaacggcctgtggggctgcttcacatggggcacaacccagggcctcggcaccatcacgctcgctctggtcgagaacggcctgccagcgaccgatatccagaaggcccggaacaacatcgctaaggctgctgacaggtggctggagaacatcgaggagcagggctaccgcctccctatcaagcaggctgaggacgagaggggcggctacccgtggggcagcaactcgttcatcctcaaccagatgatcgtgatgggctacgcgtacgacttcacgggcaactctaagtacctggacggcatgcaggatggcatgtcctacctcctgggccgcaacggcctcgatcagagctacgtcaccggctacggcgagcgccccctgcagaacccacacgacaggttctggacacctcagacctccaagaagttcccagctccaccaccaggcatcatcgctggcggccccaacagcaggttcgaggacccaacaatcaccgccgcggtgaagaaggatacacctccgcagaagtgctacatcgaccataccgattcttggtccacaaacgagatcaccgtcaactggaacgctccattcgcttgggtgaccgcttacctcgacgagatcgatctgatcggc

SEQ ID NO: 92 - DNA, 1014 bp, Dictyoglomus thermophilum
  misc_feature (1)..(1014): P77853 coding sequence
atgcaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 93 - DNA, 2610 bp, Clostridium thermocellum
  misc_feature (1)..(2610): O68438 coding sequence
atgctggaggacaagtctcccaaactgcctgattataagaacgaccttctgtacgaacgcacattcgacgaggggctctgcttcccgtggcacacgtgcgaagattcaggagggaaatgcgattttgccgtggtcgacgttccaggcgagcctgggaacaaggcgttcaggctcactgttatcgataagggtcagaacaagtggtcggtccaaatgagacaccggggtatcacgttggagcaggggcacacatacaccgttcggtttactatctggagcgacaagagctgccgcgtgtatgccaaaatcggccaaatgggtgaaccctacacggagtactggaacaataactggaatccgttcaacctcactccggggcagaaattgacggtggaacagaactttactatgaattatcccacggacgacacgtgtgagtttaccttccacttgggaggggaactggcagccgggaccccttactacgtgtacctcgacgacgtttctctttacgatccccgctttgtcaagccagtggaatacgtcctgcctcaaccggatgtcagggttaatcaagttggatacctcccttttgctaagaaatatgctactgtcgtgtcatcgagcacgtccccattgaagtggcaacttctgaatagtgcaaaccaagttgtcttggagggcaatacaatccccaagggactggacaaagattcacaagactacgttcattggatcgatttctcgaactttaagaccgaaggcaaggggtactatttcaagttgcccactgtgaactccgatactaactactcccacccgtttgatatttctgcagatatctattcaaagatgaagttcgacgcgctcgctttcttttaccataaaaggtcgggaataccaatcgagatgccctacgccgggggagagcagtggacaaggcccgcagggcacattggtgtcgcgccgaacaagggcgacacgaatgtgccaacttggccccaggatgacgaatatgctggacgcccccagaaatactatacgaaagacgtgaccggcgggtggtacgatgccggtgaccacggcaagtacgtcgtgaacgggggtatcgcagtttggacccttatgaatatgtacgagagagcaaagattagaggaatcgctaaccagggtgcctacaaagatggaggaatgaatatcccggaaaggaataacggctatcctgatattctggacgaggccagatgggagatcgaattttttaagaagatgcaagtcactgagaaagaagatccgtcgattgcaggtatggtgcaccacaagatccacgatttcaggtggacggcgctcggaatgttgcctcacgaggacccccagccacgctaccttcggcccgtcagcacagcggcaaccctgaatttcgcagcgaccctcgctcagtctgccagattgtggaaggattacgacccgacttttgcagcggactgccttgagaaagctgaaattgcctggcaagcagcactcaaacacccggacatctacgctgagtacacgccaggaagcggtgggccgggtggaggtccttataatgacgattatgtcggggacgagttctactgggccgcttgtgaactctatgtgacaaccggtaaggatgagtacaagaattacttgatgaatagtccgcactatctggaaatgccagcgaagatgggcgagaacggaggggctaacggcgaggacaacggtctctggggctgctttacttggggaacgacacaggggttgggtacaattacccttgccctcgttgaaaacggcctcccttcggcggatattcaaaaggcccgcaacaatatcgctaaagccgcagataagtggcttgagaatattgaagaacaaggttaccgcctgcctatcaaacaagcggaggatgaacggggcggatacccgtggggtagtaattctttcattctcaaccagatgatcgtcatgggctacgcttacgacttcacgggaaacagcaagtatcttgacgggatgcaggacggcatgtcctacctgctcggtagaaacggacttgatcaatcgtacgttactgggtacggggagaggccacttcagaacccccacgaccgcttttggacccctcaaacttcgaagaaattcccggccccaccccctggtattatcgcaggcgggccgaatagccggtttgaagatccaacgatcactgcagcggttaagaaggatacacccccgcagaagtgctatattgaccacaccgattcctggtctactaacgagatcacgattaattggaacgcccccttcgcgtgggtcacagcgtatctggacgaaattgacttgattaccccacccggcggagtggaccctgaagagccggaagttatctacggtgattgtaacggcgacggaaaggttaattcgaccgatgctgtggcccttaaaaggtatatcctccgcagcggtatctcgatcaacacggacaacgcggacgttaatgcagatggtcgcgtgaatagcactgacctcgctattttgaagcgctatattttgaaggagatcgatgttcttcctcacaagtga

SEQ ID NO: 94 - DNA, 732 bp, Rhodothermus marinus
  misc_feature (1)..(732): O33897 coding sequence
tgcgattggctgttccctgatggagataatggaaaggagcccgaaccagaaccagaaccaacggtagagctctgcggaagatgggatgcaagagacgtagcgggaggaagatatagagttattaacaatgtgtggggggccgaaacagcacagtgtatagaagtaggtcttgaaacaggtaattttacgataacaagagccgatcatgacaatggtaataatgttgcagcatatccagcaatttacttcggatgtcattgggcaccagcgagagcaataagggattgtgccgcgcgtgcgggagcggttaggagagcacacgaattggatgttacaccaattaccacgggaagatggaacgcagcttacgatatatggtttagtccggtaacaaactctggtaacgggtactcgggaggcgccgaacttatgatatggctgaattggaatggtggcgtaatgccaggaggatcacgggtagcaactgtcgaattggctggagcgacatgggaagtgtggtatgcagattgggattggaattacatcgcatatagaagaacgactccgacaacctcagtgagtgaacttgacttgaaagcctttattgatgatgcagtagcgagaggatacataaggccagaatggtatctgcatgcagtggaaacgggatttgaattgtgggaagggggggctgggttgaggacagcagattttagcgtaactgtacagtga

SEQ ID NO: 95 - protein, 482 aa, Artificial Sequence
  Synthetic construct, AS146-7 intein polypeptide
CFAKDTKVYYENDTLVHFESIEDMYHKYASLGREVPFDNGYAVPLETVSVYTFDPKTGEVKRTKASYIYREKVEKLAEIRLSNGYLLRITLLHPVLVFRNGLQWVPAGMIKPGDLIVGIRSVPANAATIEESEAYFLGLFVAEGTSNPLSITTGSEELKDFIVSFIEDHDGYTPTVEVRRGLYRILFRKKTAEWLGELATSNASTKVVPERVLNAGESAIAAFLAGYLDGDGYLTESIVELVTKSRELADGLVFLLKRLGITPRISQKTIEGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRLEFHEVSSVEVVDYNDWVYDLVIPETHNFIAPNGLVLHN

SEQ ID NO: 96 - protein, 423 aa, Artificial Sequence
  Synthetic construct S158-30-108-35 intein polypeptide
CLAEGSLVLDAATGQRVPIEKVRPGMEVFSLGPDYRLYRVPVLEVLESGVGEVVRLRTRSGRTLVLTPEHPLLTPEGWKPLCDLPLGTPIAVPAELPVAGHLAPPEERVMLLALLLGDGNTKLSGRRGTRPNAFFYSKDSELLAAYRRCAEALGAKVKAYVHPTTGVVTLATLAPRPGAQDPVKRLVVEAGMVAKVEEKRVPEEVFRYRREALALFLGRLFSTDGSVEKKRISYSSASLGLAQDVAHLLLRLGITSQLRSRGPRAHKVLISGREDILRFAELIGPYLLGAKRERLAALEAEARRRLPGQGWHLRPVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHN

SEQ ID NO: 97 - protein, 425 aa, Artificial Sequence
  Synthetic construct T134-100-101 intein polypeptide
CLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKNPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVGEAERRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTV

SEQ ID NO: 98 - DNA, 1446 bp, Artificial Sequence
  Synthetic construct AS146-7 coding sequence
tgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaac

SEQ ID NO: 99 - DNA, 1269 bp, Artificial Sequence
  Synthetic construct S158-30-108-35 coding sequence
tgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctccgaactcggtcagggagaacgctggtgttgacaccagaacacccgcttttgacccccgaaggttggaaacctctttgtgacctcccgcttggaactccaattgcagtccccgcagaactgcctgtggcgggccacttggccccacctgaagaacgtgttatgctcctggctcttctgttgggggatgggaacacaaagctgtcgggtcggagaggtacacgtcctaatgccttcttctacagcaaagactccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagtcgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacaaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcctgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgtcccaccctttgcaaacttcgtgagcgaggacctggtggtgcataac

SEQ ID NO: 100 - DNA, 1276 bp, Artificial Sequence
  Synthetic construct T134-100-101 coding sequence
tgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaaaaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgggcgaggctgaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaccgtcc

SEQ ID NO: 101 - protein, 676 aa, Artificial Sequence
  Synthetic construct EU591743:AS146-7 intein modified enzyme
MAQTCLTSPQTGFHNGFFYSFWKDSPGTVNFCLLEGGRYTSNWSGINNWVGGKGWQTGSRRNITYSGSFNTSGNGYLALYGWTTNPLVEYYVVDSWGSWRPPGSDGTFLGTVNSDGGTYDIYRAQRVNAPCFAKDTKVYYENDTLVHFESIEDMYHKYASLGREVPFDNGYAVPLETVSVYTFDPKTGEVKRTKASYIYREKVEKLAEIRLSNGYLLRITLLHPVLVFRNGLQWVPAGMIKPGDLIVGIRSVPANAATIEESEAYFLGLFVAEGTSNPLSITTGSEELKDFIVSFIEDHDGYTPTVEVRRGLYRILFRKKTAEWLGELATSNASTKVVPERVLNAGESAIAAFLAGYLDGDGYLTESIVELVTKSRELADGLVFLLKRLGITPRISQKTIEGSVYYRIYITGEDRKTFEKVLEKSRIKPGEMNEGGVGRYPPALGKFLGKLYSEFRLPKRDNETAYHILTRSRNVWFTEKTLSRIEEYFREALEKLSEARKALEMGDKPELPFPWTAITKYGFTDRQVANYRTRGLPKRPELKEKVVSALLKEIERLEGVAKLALETIELARRLEFHEVSSVEVVDYNDWVYDLVIPETHNFIAPNGLVLHNSIIGNATFYQYWSVRQSKRVGGTITTGNHFDAWASVGLNLGTHNYQIMATEGYQSSGSSDITVS

SEQ ID NO: 102 - protein, 759 aa, Artificial Sequence
  Synthetic construct P77853:S158-30-108-35 intein modified enzyme
QTSITLTSNASGTFDGYNYELWKDTGNTTMTVYTQGRFSCQWSNINNALFRTGKKYNQNWQSLGTIRITYSATYNPNGNSYMCIYGWSTNPLVEFYIVESWGNWRPPGATSLGQVTIDGGTYDIYRTTRVNQPCLAEGSLVLDAATGQRVPIEKVRPGMEVFSLGPDYRLYRVPVLEVLESGVGEVVRLRTRSGRTLVLTPEHPLLTPEGWKPLCDLPLGTPIAVPAELPVAGHLAPPEERVMLLALLLGDGNTKLSGRRGTRPNAFFYSKDSELLAAYRRCAEALGAKVKAYVHPTTGVVTLATLAPRPGAQDPVKRLVVEAGMVAKVEEKRVPEEVFRYRREALALFLGRLFSTDGSVEKKRISYSSASLGLAQDVAHLLLRLGITSQLRSRGPRAHKVLISGREDILRFAELIGPYLLGAKRERLAALEAEARRRLPGQGWHLRPVLPAVAYRVSEAKRRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNSNNLARVDLRIDGRTVGTFYYQGTYPWEAPIDNVYVSAGSHTVEITVTADNGTRDVYADYLVIQ

SEQ ID NO: 103 - protein, 760 aa, Artificial Sequence
  Synthetic construct P77853:T134-100-101 intein-modified enzyme
QTSITLTSNASGTFDGYYYELWKDTGNTTMTVYTQGRFSCQWSNINNALFRTGKKYNQNWQSLGTIRITYSATYNPNGNSYLCIYGWSTNPLVEFYIVESWGNWRPPGACLAEGSLVLDAATGQRVPIEKVRPGMEVFSLGPDYRLYRVPVLEVLESGVREVVRLRTRSGRTLVLTPDHPLLTPEGWKPLCDLPLGTPIAVPAELPVAGHLAPPEERVTLLALLLGDGNTKLSGRRGTRPNAFFYSKNPELLAAYRRCAEALGAKVKAYVHPTTGVVTLATLAPRPGAQDPVKRLVVEAGMVAKAEEKRVPEEVFRYRREALALFLGRLFSTDGSVEKKRISYSSASLGLAQDVAHLLLRLGITSQLRSRGPRAHEVLISGREDILRFAELIGPYLLGAKRERLAALEAEARRRLPGQGWHLRLVLPAVAYRVGEAERRSGFSWSEAGRRVAVAGSCLSSGLNLKLPRRYLSRHRLSLLGEAFADPGLEALAEGQVLWDPIVAVEPAGKARTFDLRVPPFANFVSEDLVVHNTVPLGQVTIDGGTYDIYRTTRVNQPSIVGTATFDQYWSVRTSKRTSGTVTVTDHFRAWANRGLNLGTIDQITLCVEGYQSSGSANITQNTFSQGSSSGSSGGSSGSTTTTRIECENMSLSGPYVSRITNPFNGIALYANGDTARATVNFPASRNYNFRLRGCGNNNNLARVDLRIDGRTVGTFYYQGTYPWEAPIDNVYVSAGSHTVEITVTADNGTWDVYADYLVIQ

SEQ ID NO: 104 - DNA, 2028 bp, Artificial Sequence
  Synthetic construct EU591743:AS146-7 coding sequence
gcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacatcagggaatggatacctggctctctacggttggaccacaaacccgttggttgagtactatgttgtcgatagctggggctcctggcgccctcccggaagtgatgggacatttcttggcacagtgaactcagacggcggcacgtatgacatctacagggcgcaaagagtcaacgcaccgtgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaacagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcatga

SEQ ID NO: 105 - DNA, 2280 bp, Artificial Sequence
  Synthetic construct P77853:S158-30-108-35 coding sequence
caaacaagcattactctgacatccaacgcatccggtacgtttgacggttacaattacgaactctggaaggatactggcaatacaacaatgacggtctacactcaaggtcgcttttcctgccagtggtcgaacatcaataacgcgttgtttaggaccgggaagaaatacaaccagaattggcagtctctcggcacaatccggatcacgtactctgcgacttacaacccaaacgggaactcctacatgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctccgaactcggtcagggagaacgctggtgttgacaccagaacacccgcttttgacccccgaaggttggaaacctctttgtgacctcccgcttggaactccaattgcagtccccgcagaactgcctgtggcgggccacttggccccacctgaagaacgtgttatgctcctggctcttctgttgggggatgggaacacaaagctgtcgggtcggagaggtacacgtcctaatgccttcttctacagcaaagactccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagtcgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacaaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcctgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgtcccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacagcaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacacgggacgtgtatgccgactacctggtgatacagtga

SEQ ID NO: 106 - DNA, 2283 bp, Artificial Sequence
  Synthetic construct P77853:T134-100-101 coding sequence
caaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaaaaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgggcgaggctgaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaccgtccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagtga

SEQ ID NO: 107 - protein, 25 aa, Artificial Sequence
  Synthetic construct BAASS signal peptide
MANKHLSLSLFLVLLGLSASLASGQ

SEQ ID NO: 108 - protein, 6 aa, Artificial Sequence
  Synthetic construct SEKDEL signal peptide
SEKDEL

SEQ ID NO: 109 - protein, 8 aa, Hordeum vulgare
  SIGNAL (1)..(8): xHvVSD targeting signal
DELKAEAK

SEQ ID NO: 110 - protein, 76 aa, Zea mays
  MISC_FEATURE (1)..(76): ZmUBQm translational fusion
MQIFVKTLTGKTITLEVESSDTIDNVKAKIQDKEGIPPDQQRLIFAGKQLEDGRTLADYNIQKESTLHLVLRLRGG

SEQ ID NO: 111 - protein, 19 aa, Zea mays
  SIGNAL (1)..(19): xGZein27ss
MRVLLVALALLALAASATS

SEQ ID NO: 112 - protein, 43 aa, Hordeum vulgare
  SIGNAL (1)..(43): HvAle signal
MAHARVLLLALAVLATAAVAVASSSSFADSNPIRPVTDRAAST

SEQ ID NO: 113 - DNA, 75 bp, Artificial Sequence
  Synthetic construct BAASS coding sequence
atggcgaacaaacatttgtccctctccctcttcctcgtcctccttggcctgtcggccagcttggcctccgggcaa

SEQ ID NO: 114 - DNA, 18 bp, Artificial Sequence
  Synthetic construct SEKDEL coding sequence
agcgagaaggacgagctg

SEQ ID NO: 115 - DNA, 24 bp, Hordeum vulgare
  misc_feature (1)..(24): xHvVSD coding sequence
gacgagctgaaggccgaggccaag

SEQ ID NO: 116 - DNA, 228 bp, Zea mays
  misc_feature (1)..(228): ZmUBQm coding sequence
atgcagatctttgtgaagaccctgaccggcaagactatcaccctcgaggtggagtcttctgacaccattgacaatgtcaaggccaagatccaggacaaggagggcatccccccagaccagcagcggctcatctttgctggcaagcagctggaggacgggcgcacgcttgcggactacaacatccagaaggagagcaccctccacctggtgctccgcctcaggggaggc

SEQ ID NO: 117 - DNA, 57 bp, Zea mays
  misc_feature (1)..(57): xGZEIN27ss coding sequence
atgcgcgtgctgctcgtggccctggccctgctggctcttgctgccagcgccacctct

SEQ ID NO: 118 - DNA, 129 bp, Hordeum vulgare
  misc_feature (1)..(129): HvAle coding sequence
atggcccacgcccgcgtcctcctcctggcgctcgccgtcctggccaccgccgccgtcgccgtcgcctcctcctcctccttcgccgactccaacccgatccgcccggtgaccgaccgcgccgcctccacc

SEQ ID NO: 119 - DNA, 3885 bp, Artificial Sequence
  Synthetic construct ZmUbi1P:xGZein27ss:BD22308:HvVSD
ctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 120 - DNA, 2769 bp, Artificial Sequence
  Synthetic construct ZmPepCP: xGZein27ss27:BD25243:SEKDEL
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctaaaccatgcgcgtgctgctcgtggccctggccctgcttgctcttgccgctagcgccacctctcagaacgccgcctgggctcaatgcggcggcaacggctggaccggcagcaagacctgcgtgtccggctacaagtgcaccgtggtgaacgagtggtactcccagtgcatcccgggcaccgccgaggaacctaccaccaccctcaagaccaccaccggcggcggcagcaccccaaccggcaccccaggcaacggcaagttcctgtgggtgggcacgaacgaggctggcggcgagttcggcgagggcagcctgccaggcacctggggcaagcacttcatcttcccggacccagccgccgtggacaccctgatcagccagggctacaacgccttccgcgtccagctgcgcatggagcgcaccaacccgagcagcatgaccggccccttcgacaccgcctacctgaagaacctgaccaccatcgtggaccacatcaccggcaagggcgccaacgtgatcctggacccgcacaactacggccgctacttcgacaagatcatcaccagcaccagcgacttccagacctggtggaagaacttcgccactcagttcaagagcaacagcaaggtgatcttcgacaccaacaacgagtacaacaccatggaccagaccctggtgctgaacctgaaccaggccgccatcaacggcatcagggcagctggcgccacccagaccatcttcgtggagggcaaccagtggagcggcgcctggtcctggccagacgtgaacgacaacatgaaggccctgaccgacccgctggacaagatcgtgtacgagatgcaccagtacctggacagcgacagcagcggcaccagcccgaactgcgtgtccaccaccatcggcgtggagagggtgaaggccgccaccgagtggctgcgcaagaacaagaagatcggcatgatcggcgagctggctggcggcccaaacgacacctgcaagaccgccgtgaagaacatgctggactacctgaaggaaaacagcgatgtctggaagggcgtgacctggtgggccgctggcccatggtgggccgactacatgttcagcttcgagccgccaagcggcaccggctaccagtactacaacagcctgctcaagacctacatcagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 121 - DNA, 2942 bp, Artificial Sequence
  Synthetic construct OsUbi3P:EU591743
cgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcatgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 122 - DNA, 4413 bp, Artificial Sequence
  Synthetic construct ZmUbi1P:EU591743:AS146-7:SEKDEL
ctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcgaacaaacatttgtccctctccctcttcctcgtcctccttggcctgtcggccagcttggcctccggggcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacatcagggaatggatacctggctctctacggttggaccacaaacccgttggttgagtactatgttgtcgatagctggggctcctggcgccctcccggaagtgatgggacatttcttggcacagtgaactcagacggcggcacgtatgacatctacagggcgcaaagagtcaacgcaccgtgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaacagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 123 - DNA, 3741 bp, Artificial Sequence
  Synthetic construct ZmUbi1P:HvAle:NtEGm:SEKDEL
ctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 124 - DNA, 3039 bp, Artificial Sequence
  Synthetic construct ZmPepCP:HvAle:NtEGm:SEKDEL
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctaaaccatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 125 - DNA, 3803 bp, Artificial Sequence
  Synthetic construct OsUbi3P:HvAle:NtEGm:SEKDEL
cgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 126 - DNA, 3170 bp, Artificial Sequence
  Synthetic construct OsUbi3P:BAASS:O33897
cgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcgaacaaacatttgtccctctccctcttcctcgtcctccttggcctgtcggccagcttggcctccgggcaacaggtgtgcgattggctgttccctgatggagataatggaaaggagcccgaaccagaaccagaaccaacggtagagctctgcggaagatgggatgcaagagacgtagcgggaggaagatatagagttattaacaatgtgtggggggccgaaacagcacagtgtatagaagtaggtcttgaaacaggtaattttacgataacaagagccgatcatgacaatggtaataatgttgcagcatatccagcaatttacttcggatgtcattgggcaccagcgagagcaataagggattgtgccgcgcgtgcgggagcggttaggagagcacacgaattggatgttacaccaattaccacgggaagatggaacgcagcttacgatatatggtttagtccggtaacaaactctggtaacgggtactcgggaggcgccgaacttatgatatggctgaattggaatggtggcgtaatgccaggaggatcacgggtagcaactgtcgaattggctggagcgacatgggaagtgtggtatgcagattgggattggaattacatcgcatatagaagaacgactccgacaacctcagtgagtgaacttgacttgaaagcctttattgatgatgcagtagcgagaggatacataaggccagaatggtatctgcatgcagtggaaacgggatttgaattgtgggaagggggggctgggttgaggacagcagattttagcgtaactgtacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 127 - DNA, 2298 bp, Artificial Sequence
  Synthetic construct ZmPepCP:BAASS:O43097:SEKDEL
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccatggcgaacaaacatttgtccctctccctcttcctcgtcctccttggcctgtcggccagcttggcctccgggcaagtcttcccagctggaaacgcaacggaattggagaaaagacaaaccacccctaactctgagggctggcatgacggatactactactcttggtggagcgatggtggtgcacaggccacctatacaaacctcgaaggcggcacttatgagatttcatggggtgacggtggcaaccttgtcggcggaaaggggtggaaccccggacttaacgccagggcaatccacttcgaaggggtgtaccagcccaatggcaactcatacctggccgtctacgggtggacgcgcaatccgctggttgagtactatatcgtggagaatttcggaacttatgaccctagctccggtgccacggacctcgggacagtcgagtgtgacggaagcatctacaggctgggtaaaactacccgcgttaatgctccatcgatcgacggcacgcaaacatttgatcaatactggtccgtgcggcaggataagaggacaagcggcacagttcagacgggttgccactttgatgcctgggcaagagcggggctcaatgtgaatggggaccactactatcagattgtggcgaccgagggctatttctccagtggctatgcgcgtataaccgtcgctgatgttggaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 128 - DNA, 4967 bp, Artificial Sequence
  Synthetic construct OsUbi3P:O68438
cgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgctggaggacaagtctcccaaactgcctgattataagaacgaccttctgtacgaacgcacattcgacgaggggctctgcttcccgtggcacacgtgcgaagattcaggagggaaatgcgattttgccgtggtcgacgttccaggcgagcctgggaacaaggcgttcaggctcactgttatcgataagggtcagaacaagtggtcggtccaaatgagacaccggggtatcacgttggagcaggggcacacatacaccgttcggtttactatctggagcgacaagagctgccgcgtgtatgccaaaatcggccaaatgggtgaaccctacacggagtactggaacaataactggaatccgttcaacctcactccggggcagaaattgacggtggaacagaactttactatgaattatcccacggacgacacgtgtgagtttaccttccacttgggaggggaactggcagccgggaccccttactacgtgtacctcgacgacgtttctctttacgatccccgctttgtcaagccagtggaatacgtcctgcctcaaccggatgtcagggttaatcaagttggatacctcccttttgctaagaaatatgctactgtcgtgtcatcgagcacgtccccattgaagtggcaacttctgaatagtgcaaaccaagttgtcttggagggcaatacaatccccaagggactggacaaagattcacaagactacgttcattggatcgatttctcgaactttaagaccgaaggcaaggggtactatttcaagttgcccactgtgaactccgatactaactactcccacccgtttgatatttctgcagatatctattcaaagatgaagttcgacgcgctcgctttcttttaccataaaaggtcgggaataccaatcgagatgccctacgccgggggagagcagtggacaaggcccgcagggcacattggtgtcgcgccgaacaagggcgacacgaatgtgccaacttggccccaggatgacgaatatgctggacgcccccagaaatactatacgaaagacgtgaccggcgggtggtacgatgccggtgaccacggcaagtacgtcgtgaacgggggtatcgcagtttggacccttatgaatatgtacgagagagcaaagattagaggaatcgctaaccagggtgcctacaaagatggaggaatgaatatcccggaaaggaataacggctatcctgatattctggacgaggccagatgggagatcgaattttttaagaagatgcaagtcactgagaaagaagatccgtcgattgcaggtatggtgcaccacaagatccacgatttcaggtggacggcgctcggaatgttgcctcacgaggacccccagccacgctaccttcggcccgtcagcacagcggcaaccctgaatttcgcagcgaccctcgctcagtctgccagattgtggaaggattacgacccgacttttgcagcggactgccttgagaaagctgaaattgcctggcaagcagcactcaaacacccggacatctacgctgagtacacgccaggaagcggtgggccgggtggaggtccttataatgacgattatgtcggggacgagttctactgggccgcttgtgaactctatgtgacaaccggtaaggatgagtacaagaattacttgatgaatagtccgcactatctggaaatgccagcgaagatgggcgagaacggaggggctaacggcgaggacaacggtctctggggctgctttacttggggaacgacacaggggttgggtacaattacccttgccctcgttgaaaacggcctcccttcggcggatattcaaaaggcccgcaacaatatcgctaaagccgcagataagtggcttgagaatattgaagaacaaggttaccgcctgcctatcaaacaagcggaggatgaacggggcggatacccgtggggtagtaattctttcattctcaaccagatgatcgtcatgggctacgcttacgacttcacgggaaacagcaagtatcttgacgggatgcaggacggcatgtcctacctgctcggtagaaacggacttgatcaatcgtacgttactgggtacggggagaggccacttcagaacccccacgaccgcttttggacccctcaaacttcgaagaaattcccggccccaccccctggtattatcgcaggcgggccgaatagccggtttgaagatccaacgatcactgcagcggttaagaaggatacacccccgcagaagtgctatattgaccacaccgattcctggtctactaacgagatcacgattaattggaacgcccccttcgcgtgggtcacagcgtatctggacgaaattgacttgattaccccacccggcggagtggaccctgaagagccggaagttatctacggtgattgtaacggcgacggaaaggttaattcgaccgatgctgtggcccttaaaaggtatatcctccgcagcggtatctcgatcaacacggacaacgcggacgttaatgcagatggtcgcgtgaatagcactgacctcgctattttgaagcgctatattttgaaggagatcgatgttcttcctcacaagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 129 - DNA, 4736 bp, Artificial Sequence
  Synthetic construct OsUbi3P:P0C2S1
cgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgctggaggacaagtccagcaagctccctgactacaagaacgatctcctgtacgagcggacgttcgacgagggcctctgcttcccgtggcacacatgcgaggattcgggcggcaagtgcgacttcgctgtggtcgatgtgccaggcgagccaggcaacaaggcgttccgcctcacggtcatcgacaagggccagaacaagtggtctgtgcagatgcgccacaggggcatcacactggagcagggccatacgtacacagtcaggttcaccatctggagcgacaagtcgtgccgggtgtacgccaagatcggccagatgggcgagccgtacaccgagtactggaacaacaactggaaccctttcaacctcaccccgggccagaagctgacggtggagcagaacttcaccatgaactaccccacggacgatacatgcgagttcaccttccacctcggcggcgagctggctgctggcacgccatactacgtctacctcgacgatgtgtccctgtacgatcccaggttcgtgaagccagtcgagtatgtgctcccccagccagacgtgcgggtcaaccaggtcggctacctgcccttcgccaagaagtacgcgaccgtggtctcgtcttccacgtctccactgaagtggcagctcctgaactccgccaaccaggtggtcctggagggcaacacgatccccaagggcctcgacaaggatagccaggactacgtgcactggatcgatttctcgaacttcaagaccgagggcaagggctactacttcaagctccctacggtcaactctgacacaaactactcccacccgttcgacatcagcgcggatatctactcgaagatgaagttcgacgccctggcgttcttctaccataagcgcagcggcatccccatcgagatgccatacgccggcggcgagcagtggacgaggcctgctggccacatcggcatcgagccgaacaagggcgacacgaacgtccctacatggccacaggacgatgagtacgctggccgcccgcagaagtactacaccaaggacgtgacgggcggctggtacgacgctggcgaccacggcaagtatgtggtcaacggcggcatcgccgtctggaccctcatgaacatgtacgagagggcgaagatccggggcatcgctaaccagggcgcttacaaggacggcggcatgaacatccccgagaggaacaacggctacccagacatcctggatgaggcccgctgggagatcgagttcttcaagaagatgcaggtcaccgagaaggaggacccgtccatcgccggcatggtgcaccataagatccacgatttcaggtggacggctctcggcatgctgccacatgaggaccctcagccacgctacctcaggccggtgtccaccgctgctacgctcaacttcgctgctacgctggctcagtctgctaggctctggaaggactacgatccgacattcgccgcggattgcctggagaaggctgagatcgcttggcaggctgctctcaagcacccagacatctacgccgagtacaccccaggcagcggcggccctggcggcggcccgtacaacgacgattacgtcggcgatgagttctactgggctgcttgcgagctctacgtgaccacgggcaaggacgagtacaagaactacctgatgaactcgcctcattacctggagatgccagctaagatgggcgagaacggcggcgctaacggcgaggacaacggcctgtggggctgcttcacatggggcacaacccagggcctcggcaccatcacgctcgctctggtcgagaacggcctgccagcgaccgatatccagaaggcccggaacaacatcgctaaggctgctgacaggtggctggagaacatcgaggagcagggctaccgcctccctatcaagcaggctgaggacgagaggggcggctacccgtggggcagcaactcgttcatcctcaaccagatgatcgtgatgggctacgcgtacgacttcacgggcaactctaagtacctggacggcatgcaggatggcatgtcctacctcctgggccgcaacggcctcgatcagagctacgtcaccggctacggcgagcgccccctgcagaacccacacgacaggttctggacacctcagacctccaagaagttcccagctccaccaccaggcatcatcgctggcggccccaacagcaggttcgaggacccaacaatcaccgccgcggtgaagaaggatacacctccgcagaagtgctacatcgaccataccgattcttggtccacaaacgagatcaccgtcaactggaacgctccattcgcttgggtgaccgcttacctcgacgagatcgatctgatcggctgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 130 - DNA, 4857 bp, Artificial Sequence
  Synthetic construct ZmUbi1P:ZmUBQm:BAASS:P77853:S158-30-108-35
ctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatgcagatctttgtgaagaccctgaccggcaagactatcaccctcgaggtggagtcttctgacaccattgacaatgtcaaggccaagatccaggacaaggagggcatccccccagaccagcagcggctcatctttgctggcaagcagctggaggacgggcgcacgcttgcggactacaacatccagaaggagagcaccctccacctggtgctccgcctcaggggaggcatggcgaacaaacatttgtccctctccctcttcctcgtcctccttggcctgtcggccagcttggcctccgggcaacaaacaagcattactctgacatccaacgcatccggtacgtttgacggttacaattacgaactctggaaggatactggcaatacaacaatgacggtctacactcaaggtcgcttttcctgccagtggtcgaacatcaataacgcgttgtttaggaccgggaagaaatacaaccagaattggcagtctctcggcacaatccggatcacgtactctgcgacttacaacccaaacgggaactcctacatgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctccgaactcggtcagggagaacgctggtgttgacaccagaacacccgcttttgacccccgaaggttggaaacctctttgtgacctcccgcttggaactccaattgcagtccccgcagaactgcctgtggcgggccacttggccccacctgaagaacgtgttatgctcctggctcttctgttgggggatgggaacacaaagctgtcgggtcggagaggtacacgtcctaatgccttcttctacagcaaagactccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagtcgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacaaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcctgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgtcccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacagcaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacacgggacgtgtatgccgactacctggtgatacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 131 - DNA, 4671 bp, Artificial Sequence
  Synthetic construct ZmUbi1P:BAASS:P77853:T134-100-101:SEKDEL
ctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcgaacaaacatttgtccctctccctcttcctcgtcctccttggcctgtcggccagcttggcctccgggcaacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaaaaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgggcgaggctgaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaccgtccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 132 - DNA, 14074 bp, Artificial Sequence
  Synthetic construct 2379
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctttaccgatgggcactcgagatgcagaagatttactttcatccgactcgggtgcttcaggtgcttttgtcaatttagctcgaagcttctctaaagaaacacctctgtttacttcctctattaactcagctcgtgcagcttcatactcctccttttcttgctctggtgtgtatgactgctttccccttctttcccaccgaaggtaagcttggatctgcacaagatcctctggcaccaaggtagaagtagcagaagaggaggcaccagatgcaccagtaccctgatggcggctcgactggaactgaacctgaaaattctggccattgtttttaaaccatttgttctgtgtctcgtcaaagatgaggaactcaatggcgtgcaccccaggatcatctatctcaatccttagagtggagttatcacctgactttacaaaaggtgtcctgagagccctgttcttgtacactgtcgttccatcaggttttctggacgggaggaattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagtttcctcccgtccagaaaacctgatggaacgacagtgtacaagaacagggctctcaggacaccttttgtaaagtcaggtgataactccactctaaggattgagatagatgatcctggggtgcacgccattgagttcctcatctttgacgagacacagaacaaatggtttaaaaacaatggccagaattttcaggttcagttccagtcgagccgccatcagggtactggtgcatctggtgcctcctcttctgctacttctaccttggtgccagaggatcttgtgcagatccaagcttaccttcggtgggaaagaaggggaaagcagtcatacacaccagagcaagaaaaggaggagtatgaagctgcacgagctgagttaatagaggaagtaaacagaggtgtttctttagagaagcttcgagctaaattgacaaaagcacctgaagcacccgagtcggatgaaagtaaatcttctgcatctcgagtgcccatcggtaaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgctggaggacaagtctcccaaactgcctgattataagaacgaccttctgtacgaacgcacattcgacgaggggctctgcttcccgtggcacacgtgcgaagattcaggagggaaatgcgattttgccgtggtcgacgttccaggcgagcctgggaacaaggcgttcaggctcactgttatcgataagggtcagaacaagtggtcggtccaaatgagacaccggggtatcacgttggagcaggggcacacatacaccgttcggtttactatctggagcgacaagagctgccgcgtgtatgccaaaatcggccaaatgggtgaaccctacacggagtactggaacaataactggaatccgttcaacctcactccggggcagaaattgacggtggaacagaactttactatgaattatcccacggacgacacgtgtgagtttaccttccacttgggaggggaactggcagccgggaccccttactacgtgtacctcgacgacgtttctctttacgatccccgctttgtcaagccagtggaatacgtcctgcctcaaccggatgtcagggttaatcaagttggatacctcccttttgctaagaaatatgctactgtcgtgtcatcgagcacgtccccattgaagtggcaacttctgaatagtgcaaaccaagttgtcttggagggcaatacaatccccaagggactggacaaagattcacaagactacgttcattggatcgatttctcgaactttaagaccgaaggcaaggggtactatttcaagttgcccactgtgaactccgatactaactactcccacccgtttgatatttctgcagatatctattcaaagatgaagttcgacgcgctcgctttcttttaccataaaaggtcgggaataccaatcgagatgccctacgccgggggagagcagtggacaaggcccgcagggcacattggtgtcgcgccgaacaagggcgacacgaatgtgccaacttggccccaggatgacgaatatgctggacgcccccagaaatactatacgaaagacgtgaccggcgggtggtacgatgccggtgaccacggcaagtacgtcgtgaacgggggtatcgcagtttggacccttatgaatatgtacgagagagcaaagattagaggaatcgctaaccagggtgcctacaaagatggaggaatgaatatcccggaaaggaataacggctatcctgatattctggacgaggccagatgggagatcgaattttttaagaagatgcaagtcactgagaaagaagatccgtcgattgcaggtatggtgcaccacaagatccacgatttcaggtggacggcgctcggaatgttgcctcacgaggacccccagccacgctaccttcggcccgtcagcacagcggcaaccctgaatttcgcagcgaccctcgctcagtctgccagattgtggaaggattacgacccgacttttgcagcggactgccttgagaaagctgaaattgcctggcaagcagcactcaaacacccggacatctacgctgagtacacgccaggaagcggtgggccgggtggaggtccttataatgacgattatgtcggggacgagttctactgggccgcttgtgaactctatgtgacaaccggtaaggatgagtacaagaattacttgatgaatagtccgcactatctggaaatgccagcgaagatgggcgagaacggaggggctaacggcgaggacaacggtctctggggctgctttacttggggaacgacacaggggttgggtacaattacccttgccctcgttgaaaacggcctcccttcggcggatattcaaaaggcccgcaacaatatcgctaaagccgcagataagtggcttgagaatattgaagaacaaggttaccgcctgcctatcaaacaagcggaggatgaacggggcggatacccgtggggtagtaattctttcattctcaaccagatgatcgtcatgggctacgcttacgacttcacgggaaacagcaagtatcttgacgggatgcaggacggcatgtcctacctgctcggtagaaacggacttgatcaatcgtacgttactgggtacggggagaggccacttcagaacccccacgaccgcttttggacccctcaaacttcgaagaaattcccggccccaccccctggtattatcgcaggcgggccgaatagccggtttgaagatccaacgatcactgcagcggttaagaaggatacacccccgcagaagtgctatattgaccacaccgattcctggtctactaacgagatcacgattaattggaacgcccccttcgcgtgggtcacagcgtatctggacgaaattgacttgattaccccacccggcggagtggaccctgaagagccggaagttatctacggtgattgtaacggcgacggaaaggttaattcgaccgatgctgtggcccttaaaaggtatatcctccgcagcggtatctcgatcaacacggacaacgcggacgttaatgcagatggtcgcgtgaatagcactgacctcgctattttgaagcgctatattttgaaggagatcgatgttcttcctcacaagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcgaacaaacatttgtccctctccctcttcctcgtcctccttggcctgtcggccagcttggcctccgggcaacaggtgtgcgattggctgttccctgatggagataatggaaaggagcccgaaccagaaccagaaccaacggtagagctctgcggaagatgggatgcaagagacgtagcgggaggaagatatagagttattaacaatgtgtggggggccgaaacagcacagtgtatagaagtaggtcttgaaacaggtaattttacgataacaagagccgatcatgacaatggtaataatgttgcagcatatccagcaatttacttcggatgtcattgggcaccagcgagagcaataagggattgtgccgcgcgtgcgggagcggttaggagagcacacgaattggatgttacaccaattaccacgggaagatggaacgcagcttacgatatatggtttagtccggtaacaaactctggtaacgggtactcgggaggcgccgaacttatgatatggctgaattggaatggtggcgtaatgccaggaggatcacgggtagcaactgtcgaattggctggagcgacatgggaagtgtggtatgcagattgggattggaattacatcgcatatagaagaacgactccgacaacctcagtgagtgaacttgacttgaaagcctttattgatgatgcagtagcgagaggatacataaggccagaatggtatctgcatgcagtggaaacgggatttgaattgtgggaagggggggctgggttgaggacagcagattttagcgtaactgtacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcatgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 133 - DNA, 14160 bp, Artificial Sequence
  Synthetic construct 2380
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatccgaggtatgctatattccgagacttggccccaaccatttcctcagagaattcttcggctgatattgcatattttccaagaaatttcttcttggccaatgaaatagatggtactgcatggccaacttctgcatttggagaacttgattgctgaagttcactctctgtgatctccctataggttatatctgcagaagtaggcttgaaggaaaacagtttctgatcatatccttcaagttcagatagagtggtgtggtcaaaacaggtcgcaaacagtaccttgctattccttgctcggactgacacatgagacagaacatctggcatatcaggtgtaattacaccaactactccatctggtatttcttcctctcccttgacactctttgccacaaggatggttggtttatcataagatttgttctggacagcaagtaactcatcaaccacaaccacataacctgatacttcaaccgggcttataacctgccaacttccgaggtgagcaacattccttaaaacaggatcaaatcggttcagaagattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagttcttctgaaccgatttgatcctgttttaaggaatgttgctcacctcggaagttggcaggttataagcccggttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtctcatgtgtcagtccgagcaaggaatagcaaggtactgtttgcgacctgttttgaccacaccactctatctgaacttgaaggatatgatcagaaactgttttccttcaagcctacttctgcagatataacctatagggagatcacagagagtgaacttcagcaatcaagttctccaaatgcagaagttggccatgcagtaccatctatttcattggccaagaagaaatttcttggaaaatatgcaatatcagccgaagaattctctgaggaaatggttggggccaagtctcggaatatagcatacctccctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgctggaggacaagtctcccaaactgcctgattataagaacgaccttctgtacgaacgcacattcgacgaggggctctgcttcccgtggcacacgtgcgaagattcaggagggaaatgcgattttgccgtggtcgacgttccaggcgagcctgggaacaaggcgttcaggctcactgttatcgataagggtcagaacaagtggtcggtccaaatgagacaccggggtatcacgttggagcaggggcacacatacaccgttcggtttactatctggagcgacaagagctgccgcgtgtatgccaaaatcggccaaatgggtgaaccctacacggagtactggaacaataactggaatccgttcaacctcactccggggcagaaattgacggtggaacagaactttactatgaattatcccacggacgacacgtgtgagtttaccttccacttgggaggggaactggcagccgggaccccttactacgtgtacctcgacgacgtttctctttacgatccccgctttgtcaagccagtggaatacgtcctgcctcaaccggatgtcagggttaatcaagttggatacctcccttttgctaagaaatatgctactgtcgtgtcatcgagcacgtccccattgaagtggcaacttctgaatagtgcaaaccaagttgtcttggagggcaatacaatccccaagggactggacaaagattcacaagactacgttcattggatcgatttctcgaactttaagaccgaaggcaaggggtactatttcaagttgcccactgtgaactccgatactaactactcccacccgtttgatatttctgcagatatctattcaaagatgaagttcgacgcgctcgctttcttttaccataaaaggtcgggaataccaatcgagatgccctacgccgggggagagcagtggacaaggcccgcagggcacattggtgtcgcgccgaacaagggcgacacgaatgtgccaacttggccccaggatgacgaatatgctggacgcccccagaaatactatacgaaagacgtgaccggcgggtggtacgatgccggtgaccacggcaagtacgtcgtgaacgggggtatcgcagtttggacccttatgaatatgtacgagagagcaaagattagaggaatcgctaaccagggtgcctacaaagatggaggaatgaatatcccggaaaggaataacggctatcctgatattctggacgaggccagatgggagatcgaattttttaagaagatgcaagtcactgagaaagaagatccgtcgattgcaggtatggtgcaccacaagatccacgatttcaggtggacggcgctcggaatgttgcctcacgaggacccccagccacgctaccttcggcccgtcagcacagcggcaaccctgaatttcgcagcgaccctcgctcagtctgccagattgtggaaggattacgacccgacttttgcagcggactgccttgagaaagctgaaattgcctggcaagcagcactcaaacacccggacatctacgctgagtacacgccaggaagcggtgggccgggtggaggtccttataatgacgattatgtcggggacgagttctactgggccgcttgtgaactctatgtgacaaccggtaaggatgagtacaagaattacttgatgaatagtccgcactatctggaaatgccagcgaagatgggcgagaacggaggggctaacggcgaggacaacggtctctggggctgctttacttggggaacgacacaggggttgggtacaattacccttgccctcgttgaaaacggcctcccttcggcggatattcaaaaggcccgcaacaatatcgctaaagccgcagataagtggcttgagaatattgaagaacaaggttaccgcctgcctatcaaacaagcggaggatgaacggggcggatacccgtggggtagtaattctttcattctcaaccagatgatcgtcatgggctacgcttacgacttcacgggaaacagcaagtatcttgacgggatgcaggacggcatgtcctacctgctcggtagaaacggacttgatcaatcgtacgttactgggtacggggagaggccacttcagaacccccacgaccgcttttggacccctcaaacttcgaagaaattcccggccccaccccctggtattatcgcaggcgggccgaatagccggtttgaagatccaacgatcactgcagcggttaagaaggatacacccccgcagaagtgctatattgaccacaccgattcctggtctactaacgagatcacgattaattggaacgcccccttcgcgtgggtcacagcgtatctggacgaaattgacttgattaccccacccggcggagtggaccctgaagagccggaagttatctacggtgattgtaacggcgacggaaaggttaattcgaccgatgctgtggcccttaaaaggtatatcctccgcagcggtatctcgatcaacacggacaacgcggacgttaatgcagatggtcgcgtgaatagcactgacctcgctattttgaagcgctatattttgaaggagatcgatgttcttcctcacaagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcgaacaaacatttgtccctctccctcttcctcgtcctccttggcctgtcggccagcttggcctccgggcaacaggtgtgcgattggctgttccctgatggagataatggaaaggagcccgaaccagaaccagaaccaacggtagagctctgcggaagatgggatgcaagagacgtagcgggaggaagatatagagttattaacaatgtgtggggggccgaaacagcacagtgtatagaagtaggtcttgaaacaggtaattttacgataacaagagccgatcatgacaatggtaataatgttgcagcatatccagcaatttacttcggatgtcattgggcaccagcgagagcaataagggattgtgccgcgcgtgcgggagcggttaggagagcacacgaattggatgttacaccaattaccacgggaagatggaacgcagcttacgatatatggtttagtccggtaacaaactctggtaacgggtactcgggaggcgccgaacttatgatatggctgaattggaatggtggcgtaatgccaggaggatcacgggtagcaactgtcgaattggctggagcgacatgggaagtgtggtatgcagattgggattggaattacatcgcatatagaagaacgactccgacaacctcagtgagtgaacttgacttgaaagcctttattgatgatgcagtagcgagaggatacataaggccagaatggtatctgcatgcagtggaaacgggatttgaattgtgggaagggggggctgggttgaggacagcagattttagcgtaactgtacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacaccagggaatggatacctggctctctacggttggaccaccaacccgttggttgagtactatgttgtcgatagctggggctcctggcgccctcccggaagtgatgggacatttcttggcacagtgaactcagacggcggcacgtatgacatctacagggcgcaaagagtcaacgcaccgagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcatgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 134 - DNA, 15506 bp, Artificial Sequence
  Synthetic construct 4106
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctttaccgatgggcactcgagatgcagaagatttactttcatccgactcgggtgcttcaggtgcttttgtcaatttagctcgaagcttctctaaagaaacacctctgtttacttcctctattaactcagctcgtgcagcttcatactcctccttttcttgctctggtgtgtatgactgctttccccttctttcccaccgaaggtaagcttggatctgcacaagatcctctggcaccaaggtagaagtagcagaagaggaggcaccagatgcaccagtaccctgatggcggctcgactggaactgaacctgaaaattctggccattgtttttaaaccatttgttctgtgtctcgtcaaagatgaggaactcaatggcgtgcaccccaggatcatctatctcaatccttagagtggagttatcacctgactttacaaaaggtgtcctgagagccctgttcttgtacactgtcgttccatcaggttttctggacgggaggaattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagtttcctcccgtccagaaaacctgatggaacgacagtgtacaagaacagggctctcaggacaccttttgtaaagtcaggtgataactccactctaaggattgagatagatgatcctggggtgcacgccattgagttcctcatctttgacgagacacagaacaaatggtttaaaaacaatggccagaattttcaggttcagttccagtcgagccgccatcagggtactggtgcatctggtgcctcctcttctgctacttctaccttggtgccagaggatcttgtgcagatccaagcttaccttcggtgggaaagaaggggaaagcagtcatacacaccagagcaagaaaaggaggagtatgaagctgcacgagctgagttaatagaggaagtaaacagaggtgtttctttagagaagcttcgagctaaattgacaaaagcacctgaagcacccgagtcggatgaaagtaaatcttctgcatctcgagtgcccatcggtaaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtactgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatgcagatctttgtgaagaccctgaccggcaagactatcaccctcgaggtggagtcttctgacaccattgacaatgtcaaggccaagatccaggacaaggagggcatccccccagaccagcagcggctcatctttgctggcaagcagctggaggacgggcgcacgcttgcggactacaacatccagaaggagagcaccctccacctggtgctccgcctcaggggaggcatggcgaacaaacatttgtccctctccctcttcctcgtcctccttggcctgtcggccagcttggcctccgggcaacaaacaagcattactctgacatccaacgcatccggtacgtttgacggttacaattacgaactctggaaggatactggcaatacaacaatgacggtctacactcaaggtcgcttttcctgccagtggtcgaacatcaataacgcgttgtttaggaccgggaagaaatacaaccagaattggcagtctctcggcacaatccggatcacgtactctgcgacttacaacccaaacgggaactcctacatgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctccgaactcggtcagggagaacgctggtgttgacaccagaacacccgcttttgacccccgaaggttggaaacctctttgtgacctcccgcttggaactccaattgcagtccccgcagaactgcctgtggcgggccacttggccccacctgaagaacgtgttatgctcctggctcttctgttgggggatgggaacacaaagctgtcgggtcggagaggtacacgtcctaatgccttcttctacagcaaagactccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagtcgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacaaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcctgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgtcccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacagcaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacacgggacgtgtatgccgactacctggtgatacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 135 - DNA, 15592 bp, Artificial Sequence
  Synthetic construct 4107
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatccgaggtatgctatattccgagacttggccccaaccatttcctcagagaattcttcggctgatattgcatattttccaagaaatttcttcttggccaatgaaatagatggtactgcatggccaacttctgcatttggagaacttgattgctgaagttcactctctgtgatctccctataggttatatctgcagaagtaggcttgaaggaaaacagtttctgatcatatccttcaagttcagatagagtggtgtggtcaaaacaggtcgcaaacagtaccttgctattccttgctcggactgacacatgagacagaacatctggcatatcaggtgtaattacaccaactactccatctggtatttcttcctctcccttgacactctttgccacaaggatggttggtttatcataagatttgttctggacagcaagtaactcatcaaccacaaccacataacctgatacttcaaccgggcttataacctgccaacttccgaggtgagcaacattccttaaaacaggatcaaatcggttcagaagattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagttcttctgaaccgatttgatcctgttttaaggaatgttgctcacctcggaagttggcaggttataagcccggttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtctcatgtgtcagtccgagcaaggaatagcaaggtactgtttgcgacctgttttgaccacaccactctatctgaacttgaaggatatgatcagaaactgttttccttcaagcctacttctgcagatataacctatagggagatcacagagagtgaacttcagcaatcaagttctccaaatgcagaagttggccatgcagtaccatctatttcattggccaagaagaaatttcttggaaaatatgcaatatcagccgaagaattctctgaggaaatggttggggccaagtctcggaatatagcatacctccctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtactgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatgcagatctttgtgaagaccctgaccggcaagactatcaccctcgaggtggagtcttctgacaccattgacaatgtcaaggccaagatccaggacaaggagggcatccccccagaccagcagcggctcatctttgctggcaagcagctggaggacgggcgcacgcttgcggactacaacatccagaaggagagcaccctccacctggtgctccgcctcaggggaggcatggcgaacaaacatttgtccctctccctcttcctcgtcctccttggcctgtcggccagcttggcctccgggcaacaaacaagcattactctgacatccaacgcatccggtacgtttgacggttacaattacgaactctggaaggatactggcaatacaacaatgacggtctacactcaaggtcgcttttcctgccagtggtcgaacatcaataacgcgttgtttaggaccgggaagaaatacaaccagaattggcagtctctcggcacaatccggatcacgtactctgcgacttacaacccaaacgggaactcctacatgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctccgaactcggtcagggagaacgctggtgttgacaccagaacacccgcttttgacccccgaaggttggaaacctctttgtgacctcccgcttggaactccaattgcagtccccgcagaactgcctgtggcgggccacttggccccacctgaagaacgtgttatgctcctggctcttctgttgggggatgggaacacaaagctgtcgggtcggagaggtacacgtcctaatgccttcttctacagcaaagactccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagtcgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacaaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcctgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgtcccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacagcaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacacgggacgtgtatgccgactacctggtgatacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 136 - DNA, 15161 bp, Artificial Sequence
  Synthetic construct 4108
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctgcttcaggtgtttttgtcaatttagctcgaagcttctctaaagaaacacctctatttaattcctctattaactcagctcgtgcagcttcatactcctccttttcttgctctggtgtgtatgactgctttccctttctttcccaccgaaggtaagcttggatctgcacaagatcctctggcaccaaggtagaagtagcagaagaggaggcaccagatgcaccattaccctgatggcggctcgactggagctgaatctgaaaattctggccattgtttttaaaccatttgttctgtgtctcgccaaagatgaggaactcaatagcttgcaccgcaggatcatctatctcaattctaagagtagagttatcaccagactttacaaaaggcgtcctaagagccctgttcttgtacaccgtcgttccatcaggttgtctggatgggaggatgggaggccaaggtatctaatcagccatcccacatttgggtcttgtcagtagatatgatgcagcaactcgcggttgacttgcgctttcttggcggcttatctgtcttaggggcagactcctcctcccatccagacaacctgatggaacgacggtgtacaagaacagggctcttaggacgccttttgtaaagtctggtgataactctactcttagaattgagatagatgatcctgcggtgcaagctattgagttcctcatctttggcgagacacagaacaaatggtttaaaaacaatggccagaattttcagattcagctccagtcgagccgccatcagggtaatggtgcatctggtgcctcctcttctgctacttctaccttggtgccagaggatcttgtgcagatccaagcttaccttcggtgggaaagaaagggaaagcagtcatacacaccagagcaagaaaaggaggagtatgaagctgcacgagctgagttaatagaggaattaaatagaggtgtttctttagagaagcttcgagctaaattgacaaaaacacctgaagcacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtactgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatgcagatctttgtgaagaccctgaccggcaagactatcaccctcgaggtggagtcttctgacaccattgacaatgtcaaggccaagatccaggacaaggagggcatccccccagaccagcagcggctcatctttgctggcaagcagctggaggacgggcgcacgcttgcggactacaacatccagaaggagagcaccctccacctggtgctccgcctcaggggaggcatggcgaacaaacatttgtccctctccctcttcctcgtcctccttggcctgtcggccagcttggcctccgggcaacaaacaagcattactctgacatccaacgcatccggtacgtttgacggttacaattacgaactctggaaggatactggcaatacaacaatgacggtctacactcaaggtcgcttttcctgccagtggtcgaacatcaataacgcgttgtttaggaccgggaagaaatacaaccagaattggcagtctctcggcacaatccggatcacgtactctgcgacttacaacccaaacgggaactcctacatgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctccgaactcggtcagggagaacgctggtgttgacaccagaacacccgcttttgacccccgaaggttggaaacctctttgtgacctcccgcttggaactccaattgcagtccccgcagaactgcctgtggcgggccacttggccccacctgaagaacgtgttatgctcctggctcttctgttgggggatgggaacacaaagctgtcgggtcggagaggtacacgtcctaatgccttcttctacagcaaagactccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagtcgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacaaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcctgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgtcccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacagcaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacacgggacgtgtatgccgactacctggtgatacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 137 - DNA, 15349 bp, Artificial Sequence
  Synthetic construct 4109
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatccgaggtatgctatattccgagacttggccccaaccatttcctcggtgaattcttcagctgatattgcatattttccaagaaatttcttcttggccaatgaaatagatggtactgcatggccaacttctgcatttggagaacttgattgctgaagctcactctctgtgatctccctataggttatatctgcagaagtaggcttgaaggaaagcagtttctgatcatatccttcaagttcagacagagtggtatggtcaaaacaggttgcaaacagtaccttgctattccttgctcggactgacacatgggacagaacatctggcatatcaggtgtaattacaccaactactccatctggtatttcttcctctcccttgacactctttgccacaaggatggttggtttatcataagatttgttctggacagcaagtaactcatcaaccacaaccacataacctgatacttcaactgggcttataacctgccaacttccaaggttagcaacgttccttagaacaggatcaaatcggttcagaagtgggaggccaaggtatctaatcagccatcccacatttgggtcttgtcagtagatatgatgcagcaactcgcggttgacttgcgctttcttggcggcttatctgtcttaggggcagactcccttctgaaccgatttgatcctgttctaaggaacgttgctaaccttggaagttggcaggttataagcccagttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtcccatgtgtcagtccgagcaaggaatagcaaggtactgtttgcaacctgttttgaccataccactctgtctgaacttgaaggatatgatcagaaactgctttccttcaagcctacttctgcagatataacctatagggagatcacagagagtgagcttcagcaatcaagttctccaaatgcagaagttggccatgcagtaccatctatttcattggccaagaagaaatttcttggaaaatatgcaatatcagctgaagaattcaccgaggaaatggttggggccaagtctcggaatatagcatacctccctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtactgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatgcagatctttgtgaagaccctgaccggcaagactatcaccctcgaggtggagtcttctgacaccattgacaatgtcaaggccaagatccaggacaaggagggcatccccccagaccagcagcggctcatctttgctggcaagcagctggaggacgggcgcacgcttgcggactacaacatccagaaggagagcaccctccacctggtgctccgcctcaggggaggcatggcgaacaaacatttgtccctctccctcttcctcgtcctccttggcctgtcggccagcttggcctccgggcaacaaacaagcattactctgacatccaacgcatccggtacgtttgacggttacaattacgaactctggaaggatactggcaatacaacaatgacggtctacactcaaggtcgcttttcctgccagtggtcgaacatcaataacgcgttgtttaggaccgggaagaaatacaaccagaattggcagtctctcggcacaatccggatcacgtactctgcgacttacaacccaaacgggaactcctacatgtgtatctatggctggtctaccaacccattggtcgagttctacatcgttgagtcctgggggaactggagaccgcctggtgccacgtccctgggccaagtgacaatcgatggcgggacctacgacatctataggacgacacgcgtcaaccagccttgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttggggaagttgtgcgcctccgaactcggtcagggagaacgctggtgttgacaccagaacacccgcttttgacccccgaaggttggaaacctctttgtgacctcccgcttggaactccaattgcagtccccgcagaactgcctgtggcgggccacttggccccacctgaagaacgtgttatgctcctggctcttctgttgggggatgggaacacaaagctgtcgggtcggagaggtacacgtcctaatgccttcttctacagcaaagactccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagtcgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacaaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcctgttcttcctgccgtggcgtacagagtgagcgaggctaaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgtcccaccctttgcaaacttcgtgagcgaggacctggtggtgcataactccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacagcaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacacgggacgtgtatgccgactacctggtgatacagtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 138 - DNA, 12974 bp, Artificial Sequence
  Syntehtic construct 4110
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctttaccgatgggcactcgagatgcagaagatttactttcatccgactcgggtgcttcaggtgcttttgtcaatttagctcgaagcttctctaaagaaacacctctgtttacttcctctattaactcagctcgtgcagcttcatactcctccttttcttgctctggtgtgtatgactgctttccccttctttcccaccgaaggtaagcttggatctgcacaagatcctctggcaccaaggtagaagtagcagaagaggaggcaccagatgcaccagtaccctgatggcggctcgactggaactgaacctgaaaattctggccattgtttttaaaccatttgttctgtgtctcgtcaaagatgaggaactcaatggcgtgcaccccaggatcatctatctcaatccttagagtggagttatcacctgactttacaaaaggtgtcctgagagccctgttcttgtacactgtcgttccatcaggttttctggacgggaggaattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagtttcctcccgtccagaaaacctgatggaacgacagtgtacaagaacagggctctcaggacaccttttgtaaagtcaggtgataactccactctaaggattgagatagatgatcctggggtgcacgccattgagttcctcatctttgacgagacacagaacaaatggtttaaaaacaatggccagaattttcaggttcagttccagtcgagccgccatcagggtactggtgcatctggtgcctcctcttctgctacttctaccttggtgccagaggatcttgtgcagatccaagcttaccttcggtgggaaagaaggggaaagcagtcatacacaccagagcaagaaaaggaggagtatgaagctgcacgagctgagttaatagaggaagtaaacagaggtgtttctttagagaagcttcgagctaaattgacaaaagcacctgaagcacccgagtcggatgaaagtaaatcttctgcatctcgagtgcccatcggtaaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgttaattaagtctaactcgagttactggtacgtactgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacctctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccatggcgaacaaacatttgtccctctccctcttcctcgtcctccttggcctgtcggccagcttggcctccgggcaagtcttcccagctggaaacgcaacggaattggagaaaagacaaaccacccctaactctgagggctggcatgacggatactactactcttggtggagcgatggtggtgcacaggccacctatacaaacctcgaaggcggcacttatgagatttcatggggtgacggtggcaaccttgtcggcggaaaggggtggaaccccggacttaacgccagggcaatccacttcgaaggggtgtaccagcccaatggcaactcatacctggccgtctacgggtggacgcgcaatccgctggttgagtactatatcgtggagaatttcggaacttatgaccctagctccggtgccacggacctcgggacagtcgagtgtgacggaagcatctacaggctgggtaaaactacccgcgttaatgctccatcgatcgacggcacgcaaacatttgatcaatactggtccgtgcggcaggataagaggacaagcggcacagttcagacgggttgccactttgatgcctgggcaagagcggggctcaatgtgaatggggaccactactatcagattgtggcgaccgagggctatttctccagtggctatgcgcgtataaccgtcgctgatgttggaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 139 - DNA, 13060 bp, Artificial Sequence
  Synthetic construct 4111
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatccgaggtatgctatattccgagacttggccccaaccatttcctcagagaattcttcggctgatattgcatattttccaagaaatttcttcttggccaatgaaatagatggtactgcatggccaacttctgcatttggagaacttgattgctgaagttcactctctgtgatctccctataggttatatctgcagaagtaggcttgaaggaaaacagtttctgatcatatccttcaagttcagatagagtggtgtggtcaaaacaggtcgcaaacagtaccttgctattccttgctcggactgacacatgagacagaacatctggcatatcaggtgtaattacaccaactactccatctggtatttcttcctctcccttgacactctttgccacaaggatggttggtttatcataagatttgttctggacagcaagtaactcatcaaccacaaccacataacctgatacttcaaccgggcttataacctgccaacttccgaggtgagcaacattccttaaaacaggatcaaatcggttcagaagattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagttcttctgaaccgatttgatcctgttttaaggaatgttgctcacctcggaagttggcaggttataagcccggttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtctcatgtgtcagtccgagcaaggaatagcaaggtactgtttgcgacctgttttgaccacaccactctatctgaacttgaaggatatgatcagaaactgttttccttcaagcctacttctgcagatataacctatagggagatcacagagagtgaacttcagcaatcaagttctccaaatgcagaagttggccatgcagtaccatctatttcattggccaagaagaaatttcttggaaaatatgcaatatcagccgaagaattctctgaggaaatggttggggccaagtctcggaatatagcatacctccctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgttaattaagtctaactcgagttactggtacgtactgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacctctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccatggcgaacaaacatttgtccctctccctcttcctcgtcctccttggcctgtcggccagcttggcctccgggcaagtcttcccagctggaaacgcaacggaattggagaaaagacaaaccacccctaactctgagggctggcatgacggatactactactcttggtggagcgatggtggtgcacaggccacctatacaaacctcgaaggcggcacttatgagatttcatggggtgacggtggcaaccttgtcggcggaaaggggtggaaccccggacttaacgccagggcaatccacttcgaaggggtgtaccagcccaatggcaactcatacctggccgtctacgggtggacgcgcaatccgctggttgagtactatatcgtggagaatttcggaacttatgaccctagctccggtgccacggacctcgggacagtcgagtgtgacggaagcatctacaggctgggtaaaactacccgcgttaatgctccatcgatcgacggcacgcaaacatttgatcaatactggtccgtgcggcaggataagaggacaagcggcacagttcagacgggttgccactttgatgcctgggcaagagcggggctcaatgtgaatggggaccactactatcagattgtggcgaccgagggctatttctccagtggctatgcgcgtataaccgtcgctgatgttggaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 140 - DNA, 15025 bp, Artificial Sequence
  Synthetic construct 4112
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctttaccgatgggcactcgagatgcagaagatttactttcatccgactcgggtgcttcaggtgcttttgtcaatttagctcgaagcttctctaaagaaacacctctgtttacttcctctattaactcagctcgtgcagcttcatactcctccttttcttgctctggtgtgtatgactgctttccccttctttcccaccgaaggtaagcttggatctgcacaagatcctctggcaccaaggtagaagtagcagaagaggaggcaccagatgcaccagtaccctgatggcggctcgactggaactgaacctgaaaattctggccattgtttttaaaccatttgttctgtgtctcgtcaaagatgaggaactcaatggcgtgcaccccaggatcatctatctcaatccttagagtggagttatcacctgactttacaaaaggtgtcctgagagccctgttcttgtacactgtcgttccatcaggttttctggacgggaggaattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagtttcctcccgtccagaaaacctgatggaacgacagtgtacaagaacagggctctcaggacaccttttgtaaagtcaggtgataactccactctaaggattgagatagatgatcctggggtgcacgccattgagttcctcatctttgacgagacacagaacaaatggtttaaaaacaatggccagaattttcaggttcagttccagtcgagccgccatcagggtactggtgcatctggtgcctcctcttctgctacttctaccttggtgccagaggatcttgtgcagatccaagcttaccttcggtgggaaagaaggggaaagcagtcatacacaccagagcaagaaaaggaggagtatgaagctgcacgagctgagttaatagaggaagtaaacagaggtgtttctttagagaagcttcgagctaaattgacaaaagcacctgaagcacccgagtcggatgaaagtaaatcttctgcatctcgagtgcccatcggtaaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtactgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtaccaaatccatggaatcaaggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcgaacaaacatttgtccctctccctcttcctcgtcctccttggcctgtcggccagcttggcctccggggcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacatcagggaatggatacctggctctctacggttggaccacaaacccgttggttgagtactatgttgtcgatagctggggctcctggcgccctcccggaagtgatgggacatttcttggcacagtgaactcagacggcggcacgtatgacatctacagggcgcaaagagtcaacgcaccgtgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaacagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 141 - DNA, 15111 bp, Artificial Sequence
  Synthetic construct 4113
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatccgaggtatgctatattccgagacttggccccaaccatttcctcagagaattcttcggctgatattgcatattttccaagaaatttcttcttggccaatgaaatagatggtactgcatggccaacttctgcatttggagaacttgattgctgaagttcactctctgtgatctccctataggttatatctgcagaagtaggcttgaaggaaaacagtttctgatcatatccttcaagttcagatagagtggtgtggtcaaaacaggtcgcaaacagtaccttgctattccttgctcggactgacacatgagacagaacatctggcatatcaggtgtaattacaccaactactccatctggtatttcttcctctcccttgacactctttgccacaaggatggttggtttatcataagatttgttctggacagcaagtaactcatcaaccacaaccacataacctgatacttcaaccgggcttataacctgccaacttccgaggtgagcaacattccttaaaacaggatcaaatcggttcagaagattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagttcttctgaaccgatttgatcctgttttaaggaatgttgctcacctcggaagttggcaggttataagcccggttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtctcatgtgtcagtccgagcaaggaatagcaaggtactgtttgcgacctgttttgaccacaccactctatctgaacttgaaggatatgatcagaaactgttttccttcaagcctacttctgcagatataacctatagggagatcacagagagtgaacttcagcaatcaagttctccaaatgcagaagttggccatgcagtaccatctatttcattggccaagaagaaatttcttggaaaatatgcaatatcagccgaagaattctctgaggaaatggttggggccaagtctcggaatatagcatacctccctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtactgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtaccaaatccatggaatcaaggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcgaacaaacatttgtccctctccctcttcctcgtcctccttggcctgtcggccagcttggcctccggggcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacatcagggaatggatacctggctctctacggttggaccacaaacccgttggttgagtactatgttgtcgatagctggggctcctggcgccctcccggaagtgatgggacatttcttggcacagtgaactcagacggcggcacgtatgacatctacagggcgcaaagagtcaacgcaccgtgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaacagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 142 - DNA, 14053 bp, Artificial Sequence
  Synthetic construct 4114
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctttaccgatgggcactcgagatgcagaagatttactttcatccgactcgggtgcttcaggtgcttttgtcaatttagctcgaagcttctctaaagaaacacctctgtttacttcctctattaactcagctcgtgcagcttcatactcctccttttcttgctctggtgtgtatgactgctttccccttctttcccaccgaaggtaagcttggatctgcacaagatcctctggcaccaaggtagaagtagcagaagaggaggcaccagatgcaccagtaccctgatggcggctcgactggaactgaacctgaaaattctggccattgtttttaaaccatttgttctgtgtctcgtcaaagatgaggaactcaatggcgtgcaccccaggatcatctatctcaatccttagagtggagttatcacctgactttacaaaaggtgtcctgagagccctgttcttgtacactgtcgttccatcaggttttctggacgggaggaattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagtttcctcccgtccagaaaacctgatggaacgacagtgtacaagaacagggctctcaggacaccttttgtaaagtcaggtgataactccactctaaggattgagatagatgatcctggggtgcacgccattgagttcctcatctttgacgagacacagaacaaatggtttaaaaacaatggccagaattttcaggttcagttccagtcgagccgccatcagggtactggtgcatctggtgcctcctcttctgctacttctaccttggtgccagaggatcttgtgcagatccaagcttaccttcggtgggaaagaaggggaaagcagtcatacacaccagagcaagaaaaggaggagtatgaagctgcacgagctgagttaatagaggaagtaaacagaggtgtttctttagagaagcttcgagctaaattgacaaaagcacctgaagcacccgagtcggatgaaagtaaatcttctgcatctcgagtgcccatcggtaaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtactgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacctctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctaaaccatgcgcgtgctgctcgtggccctggccctgcttgctcttgccgctagcgccacctctcagaacgccgcctgggctcaatgcggcggcaacggctggaccggcagcaagacctgcgtgtccggctacaagtgcaccgtggtgaacgagtggtactcccagtgcatcccgggcaccgccgaggaacctaccaccaccctcaagaccaccaccggcggcggcagcaccccaaccggcaccccaggcaacggcaagttcctgtgggtgggcacgaacgaggctggcggcgagttcggcgagggcagcctgccaggcacctggggcaagcacttcatcttcccggacccagccgccgtggacaccctgatcagccagggctacaacgccttccgcgtccagctgcgcatggagcgcaccaacccgagcagcatgaccggccccttcgacaccgcctacctgaagaacctgaccaccatcgtggaccacatcaccggcaagggcgccaacgtgatcctggacccgcacaactacggccgctacttcgacaagatcatcaccagcaccagcgacttccagacctggtggaagaacttcgccactcagttcaagagcaacagcaaggtgatcttcgacaccaacaacgagtacaacaccatggaccagaccctggtgctgaacctgaaccaggccgccatcaacggcatcagggcagctggcgccacccagaccatcttcgtggagggcaaccagtggagcggcgcctggtcctggccagacgtgaacgacaacatgaaggccctgaccgacccgctggacaagatcgtgtacgagatgcaccagtacctggacagcgacagcagcggcaccagcccgaactgcgtgtccaccaccatcggcgtggagagggtgaaggccgccaccgagtggctgcgcaagaacaagaagatcggcatgatcggcgagctggctggcggcccaaacgacacctgcaagaccgccgtgaagaacatgctggactacctgaaggaaaacagcgatgtctggaagggcgtgacctggtgggccgctggcccatggtgggccgactacatgttcagcttcgagccgccaagcggcaccggctaccagtactacaacagcctgctcaagacctacatcagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtaccaaatccatggaatcaaggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcgaacaaacatttgtccctctccctcttcctcgtcctccttggcctgtcggccagcttggcctccggggcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacatcagggaatggatacctggctctctacggttggaccacaaacccgttggttgagtactatgttgtcgatagctggggctcctggcgccctcccggaagtgatgggacatttcttggcacagtgaactcagacggcggcacgtatgacatctacagggcgcaaagagtcaacgcaccgtgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaacagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 143 - DNA, 14139 bp, Artificial Sequence
  Synthetic construct 4115
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatccgaggtatgctatattccgagacttggccccaaccatttcctcagagaattcttcggctgatattgcatattttccaagaaatttcttcttggccaatgaaatagatggtactgcatggccaacttctgcatttggagaacttgattgctgaagttcactctctgtgatctccctataggttatatctgcagaagtaggcttgaaggaaaacagtttctgatcatatccttcaagttcagatagagtggtgtggtcaaaacaggtcgcaaacagtaccttgctattccttgctcggactgacacatgagacagaacatctggcatatcaggtgtaattacaccaactactccatctggtatttcttcctctcccttgacactctttgccacaaggatggttggtttatcataagatttgttctggacagcaagtaactcatcaaccacaaccacataacctgatacttcaaccgggcttataacctgccaacttccgaggtgagcaacattccttaaaacaggatcaaatcggttcagaagattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagttcttctgaaccgatttgatcctgttttaaggaatgttgctcacctcggaagttggcaggttataagcccggttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtctcatgtgtcagtccgagcaaggaatagcaaggtactgtttgcgacctgttttgaccacaccactctatctgaacttgaaggatatgatcagaaactgttttccttcaagcctacttctgcagatataacctatagggagatcacagagagtgaacttcagcaatcaagttctccaaatgcagaagttggccatgcagtaccatctatttcattggccaagaagaaatttcttggaaaatatgcaatatcagccgaagaattctctgaggaaatggttggggccaagtctcggaatatagcatacctccctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtactgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacctctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctaaaccatgcgcgtgctgctcgtggccctggccctgcttgctcttgccgctagcgccacctctcagaacgccgcctgggctcaatgcggcggcaacggctggaccggcagcaagacctgcgtgtccggctacaagtgcaccgtggtgaacgagtggtactcccagtgcatcccgggcaccgccgaggaacctaccaccaccctcaagaccaccaccggcggcggcagcaccccaaccggcaccccaggcaacggcaagttcctgtgggtgggcacgaacgaggctggcggcgagttcggcgagggcagcctgccaggcacctggggcaagcacttcatcttcccggacccagccgccgtggacaccctgatcagccagggctacaacgccttccgcgtccagctgcgcatggagcgcaccaacccgagcagcatgaccggccccttcgacaccgcctacctgaagaacctgaccaccatcgtggaccacatcaccggcaagggcgccaacgtgatcctggacccgcacaactacggccgctacttcgacaagatcatcaccagcaccagcgacttccagacctggtggaagaacttcgccactcagttcaagagcaacagcaaggtgatcttcgacaccaacaacgagtacaacaccatggaccagaccctggtgctgaacctgaaccaggccgccatcaacggcatcagggcagctggcgccacccagaccatcttcgtggagggcaaccagtggagcggcgcctggtcctggccagacgtgaacgacaacatgaaggccctgaccgacccgctggacaagatcgtgtacgagatgcaccagtacctggacagcgacagcagcggcaccagcccgaactgcgtgtccaccaccatcggcgtggagagggtgaaggccgccaccgagtggctgcgcaagaacaagaagatcggcatgatcggcgagctggctggcggcccaaacgacacctgcaagaccgccgtgaagaacatgctggactacctgaaggaaaacagcgatgtctggaagggcgtgacctggtgggccgctggcccatggtgggccgactacatgttcagcttcgagccgccaagcggcaccggctaccagtactacaacagcctgctcaagacctacatcagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtaccaaatccatggaatcaaggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcgaacaaacatttgtccctctccctcttcctcgtcctccttggcctgtcggccagcttggcctccggggcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacatcagggaatggatacctggctctctacggttggaccacaaacccgttggttgagtactatgttgtcgatagctggggctcctggcgccctcccggaagtgatgggacatttcttggcacagtgaactcagacggcggcacgtatgacatctacagggcgcaaagagtcaacgcaccgtgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaacagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 144 - DNA, 15086 bp, Artificial Sequence
  Synthetic construct 4116
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctttaccgatgggcactcgagatgcagaagatttactttcatccgactcgggtgcttcaggtgcttttgtcaatttagctcgaagcttctctaaagaaacacctctgtttacttcctctattaactcagctcgtgcagcttcatactcctccttttcttgctctggtgtgtatgactgctttccccttctttcccaccgaaggtaagcttggatctgcacaagatcctctggcaccaaggtagaagtagcagaagaggaggcaccagatgcaccagtaccctgatggcggctcgactggaactgaacctgaaaattctggccattgtttttaaaccatttgttctgtgtctcgtcaaagatgaggaactcaatggcgtgcaccccaggatcatctatctcaatccttagagtggagttatcacctgactttacaaaaggtgtcctgagagccctgttcttgtacactgtcgttccatcaggttttctggacgggaggaattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagtttcctcccgtccagaaaacctgatggaacgacagtgtacaagaacagggctctcaggacaccttttgtaaagtcaggtgataactccactctaaggattgagatagatgatcctggggtgcacgccattgagttcctcatctttgacgagacacagaacaaatggtttaaaaacaatggccagaattttcaggttcagttccagtcgagccgccatcagggtactggtgcatctggtgcctcctcttctgctacttctaccttggtgccagaggatcttgtgcagatccaagcttaccttcggtgggaaagaaggggaaagcagtcatacacaccagagcaagaaaaggaggagtatgaagctgcacgagctgagttaatagaggaagtaaacagaggtgtttctttagagaagcttcgagctaaattgacaaaagcacctgaagcacccgagtcggatgaaagtaaatcttctgcatctcgagtgcccatcggtaaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtactgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtaccaaatccatggaatcaaggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcgaacaaacatttgtccctctccctcttcctcgtcctccttggcctgtcggccagcttggcctccggggcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacatcagggaatggatacctggctctctacggttggaccacaaacccgttggttgagtactatgttgtcgatagctggggctcctggcgccctcccggaagtgatgggacatttcttggcacagtgaactcagacggcggcacgtatgacatctacagggcgcaaagagtcaacgcaccgtgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaacagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 145 - DNA, 15172 bp, Artificial Sequence
  Synthetic construct 4117
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatccgaggtatgctatattccgagacttggccccaaccatttcctcagagaattcttcggctgatattgcatattttccaagaaatttcttcttggccaatgaaatagatggtactgcatggccaacttctgcatttggagaacttgattgctgaagttcactctctgtgatctccctataggttatatctgcagaagtaggcttgaaggaaaacagtttctgatcatatccttcaagttcagatagagtggtgtggtcaaaacaggtcgcaaacagtaccttgctattccttgctcggactgacacatgagacagaacatctggcatatcaggtgtaattacaccaactactccatctggtatttcttcctctcccttgacactctttgccacaaggatggttggtttatcataagatttgttctggacagcaagtaactcatcaaccacaaccacataacctgatacttcaaccgggcttataacctgccaacttccgaggtgagcaacattccttaaaacaggatcaaatcggttcagaagattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagttcttctgaaccgatttgatcctgttttaaggaatgttgctcacctcggaagttggcaggttataagcccggttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtctcatgtgtcagtccgagcaaggaatagcaaggtactgtttgcgacctgttttgaccacaccactctatctgaacttgaaggatatgatcagaaactgttttccttcaagcctacttctgcagatataacctatagggagatcacagagagtgaacttcagcaatcaagttctccaaatgcagaagttggccatgcagtaccatctatttcattggccaagaagaaatttcttggaaaatatgcaatatcagccgaagaattctctgaggaaatggttggggccaagtctcggaatatagcatacctccctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtactgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtaccaaatccatggaatcaaggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcgaacaaacatttgtccctctccctcttcctcgtcctccttggcctgtcggccagcttggcctccggggcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacatcagggaatggatacctggctctctacggttggaccacaaacccgttggttgagtactatgttgtcgatagctggggctcctggcgccctcccggaagtgatgggacatttcttggcacagtgaactcagacggcggcacgtatgacatctacagggcgcaaagagtcaacgcaccgtgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaacagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 146 - DNA, 16194 bp, Artificial Sequence
  Synthetic construct 4120
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctttaccgatgggcactcgagatgcagaagatttactttcatccgactcgggtgcttcaggtgcttttgtcaatttagctcgaagcttctctaaagaaacacctctgtttacttcctctattaactcagctcgtgcagcttcatactcctccttttcttgctctggtgtgtatgactgctttccccttctttcccaccgaaggtaagcttggatctgcacaagatcctctggcaccaaggtagaagtagcagaagaggaggcaccagatgcaccagtaccctgatggcggctcgactggaactgaacctgaaaattctggccattgtttttaaaccatttgttctgtgtctcgtcaaagatgaggaactcaatggcgtgcaccccaggatcatctatctcaatccttagagtggagttatcacctgactttacaaaaggtgtcctgagagccctgttcttgtacactgtcgttccatcaggttttctggacgggaggaattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagtttcctcccgtccagaaaacctgatggaacgacagtgtacaagaacagggctctcaggacaccttttgtaaagtcaggtgataactccactctaaggattgagatagatgatcctggggtgcacgccattgagttcctcatctttgacgagacacagaacaaatggtttaaaaacaatggccagaattttcaggttcagttccagtcgagccgccatcagggtactggtgcatctggtgcctcctcttctgctacttctaccttggtgccagaggatcttgtgcagatccaagcttaccttcggtgggaaagaaggggaaagcagtcatacacaccagagcaagaaaaggaggagtatgaagctgcacgagctgagttaatagaggaagtaaacagaggtgtttctttagagaagcttcgagctaaattgacaaaagcacctgaagcacccgagtcggatgaaagtaaatcttctgcatctcgagtgcccatcggtaaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgctggaggacaagtccagcaagctccctgactacaagaacgatctcctgtacgagcggacgttcgacgagggcctctgcttcccgtggcacacatgcgaggattcgggcggcaagtgcgacttcgctgtggtcgatgtgccaggcgagccaggcaacaaggcgttccgcctcacggtcatcgacaagggccagaacaagtggtctgtgcagatgcgccacaggggcatcacactggagcagggccatacgtacacagtcaggttcaccatctggagcgacaagtcgtgccgggtgtacgccaagatcggccagatgggcgagccgtacaccgagtactggaacaacaactggaaccctttcaacctcaccccgggccagaagctgacggtggagcagaacttcaccatgaactaccccacggacgatacatgcgagttcaccttccacctcggcggcgagctggctgctggcacgccatactacgtctacctcgacgatgtgtccctgtacgatcccaggttcgtgaagccagtcgagtatgtgctcccccagccagacgtgcgggtcaaccaggtcggctacctgcccttcgccaagaagtacgcgaccgtggtctcgtcttccacgtctccactgaagtggcagctcctgaactccgccaaccaggtggtcctggagggcaacacgatccccaagggcctcgacaaggatagccaggactacgtgcactggatcgatttctcgaacttcaagaccgagggcaagggctactacttcaagctccctacggtcaactctgacacaaactactcccacccgttcgacatcagcgcggatatctactcgaagatgaagttcgacgccctggcgttcttctaccataagcgcagcggcatccccatcgagatgccatacgccggcggcgagcagtggacgaggcctgctggccacatcggcatcgagccgaacaagggcgacacgaacgtccctacatggccacaggacgatgagtacgctggccgcccgcagaagtactacaccaaggacgtgacgggcggctggtacgacgctggcgaccacggcaagtatgtggtcaacggcggcatcgccgtctggaccctcatgaacatgtacgagagggcgaagatccggggcatcgctaaccagggcgcttacaaggacggcggcatgaacatccccgagaggaacaacggctacccagacatcctggatgaggcccgctgggagatcgagttcttcaagaagatgcaggtcaccgagaaggaggacccgtccatcgccggcatggtgcaccataagatccacgatttcaggtggacggctctcggcatgctgccacatgaggaccctcagccacgctacctcaggccggtgtccaccgctgctacgctcaacttcgctgctacgctggctcagtctgctaggctctggaaggactacgatccgacattcgccgcggattgcctggagaaggctgagatcgcttggcaggctgctctcaagcacccagacatctacgccgagtacaccccaggcagcggcggccctggcggcggcccgtacaacgacgattacgtcggcgatgagttctactgggctgcttgcgagctctacgtgaccacgggcaaggacgagtacaagaactacctgatgaactcgcctcattacctggagatgccagctaagatgggcgagaacggcggcgctaacggcgaggacaacggcctgtggggctgcttcacatggggcacaacccagggcctcggcaccatcacgctcgctctggtcgagaacggcctgccagcgaccgatatccagaaggcccggaacaacatcgctaaggctgctgacaggtggctggagaacatcgaggagcagggctaccgcctccctatcaagcaggctgaggacgagaggggcggctacccgtggggcagcaactcgttcatcctcaaccagatgatcgtgatgggctacgcgtacgacttcacgggcaactctaagtacctggacggcatgcaggatggcatgtcctacctcctgggccgcaacggcctcgatcagagctacgtcaccggctacggcgagcgccccctgcagaacccacacgacaggttctggacacctcagacctccaagaagttcccagctccaccaccaggcatcatcgctggcggccccaacagcaggttcgaggacccaacaatcaccgccgcggtgaagaaggatacacctccgcagaagtgctacatcgaccataccgattcttggtccacaaacgagatcaccgtcaactggaacgctccattcgcttgggtgaccgcttacctcgacgagatcgatctgatcggctgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcgaacaaacatttgtccctctccctcttcctcgtcctccttggcctgtcggccagcttggcctccgggcaacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaaaaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgggcgaggctgaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaccgtccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 147 - DNA, 16280 bp, Artificial Sequence
  Synthetic construct 4121
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatccgaggtatgctatattccgagacttggccccaaccatttcctcagagaattcttcggctgatattgcatattttccaagaaatttcttcttggccaatgaaatagatggtactgcatggccaacttctgcatttggagaacttgattgctgaagttcactctctgtgatctccctataggttatatctgcagaagtaggcttgaaggaaaacagtttctgatcatatccttcaagttcagatagagtggtgtggtcaaaacaggtcgcaaacagtaccttgctattccttgctcggactgacacatgagacagaacatctggcatatcaggtgtaattacaccaactactccatctggtatttcttcctctcccttgacactctttgccacaaggatggttggtttatcataagatttgttctggacagcaagtaactcatcaaccacaaccacataacctgatacttcaaccgggcttataacctgccaacttccgaggtgagcaacattccttaaaacaggatcaaatcggttcagaagattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagttcttctgaaccgatttgatcctgttttaaggaatgttgctcacctcggaagttggcaggttataagcccggttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtctcatgtgtcagtccgagcaaggaatagcaaggtactgtttgcgacctgttttgaccacaccactctatctgaacttgaaggatatgatcagaaactgttttccttcaagcctacttctgcagatataacctatagggagatcacagagagtgaacttcagcaatcaagttctccaaatgcagaagttggccatgcagtaccatctatttcattggccaagaagaaatttcttggaaaatatgcaatatcagccgaagaattctctgaggaaatggttggggccaagtctcggaatatagcatacctccctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgctggaggacaagtccagcaagctccctgactacaagaacgatctcctgtacgagcggacgttcgacgagggcctctgcttcccgtggcacacatgcgaggattcgggcggcaagtgcgacttcgctgtggtcgatgtgccaggcgagccaggcaacaaggcgttccgcctcacggtcatcgacaagggccagaacaagtggtctgtgcagatgcgccacaggggcatcacactggagcagggccatacgtacacagtcaggttcaccatctggagcgacaagtcgtgccgggtgtacgccaagatcggccagatgggcgagccgtacaccgagtactggaacaacaactggaaccctttcaacctcaccccgggccagaagctgacggtggagcagaacttcaccatgaactaccccacggacgatacatgcgagttcaccttccacctcggcggcgagctggctgctggcacgccatactacgtctacctcgacgatgtgtccctgtacgatcccaggttcgtgaagccagtcgagtatgtgctcccccagccagacgtgcgggtcaaccaggtcggctacctgcccttcgccaagaagtacgcgaccgtggtctcgtcttccacgtctccactgaagtggcagctcctgaactccgccaaccaggtggtcctggagggcaacacgatccccaagggcctcgacaaggatagccaggactacgtgcactggatcgatttctcgaacttcaagaccgagggcaagggctactacttcaagctccctacggtcaactctgacacaaactactcccacccgttcgacatcagcgcggatatctactcgaagatgaagttcgacgccctggcgttcttctaccataagcgcagcggcatccccatcgagatgccatacgccggcggcgagcagtggacgaggcctgctggccacatcggcatcgagccgaacaagggcgacacgaacgtccctacatggccacaggacgatgagtacgctggccgcccgcagaagtactacaccaaggacgtgacgggcggctggtacgacgctggcgaccacggcaagtatgtggtcaacggcggcatcgccgtctggaccctcatgaacatgtacgagagggcgaagatccggggcatcgctaaccagggcgcttacaaggacggcggcatgaacatccccgagaggaacaacggctacccagacatcctggatgaggcccgctgggagatcgagttcttcaagaagatgcaggtcaccgagaaggaggacccgtccatcgccggcatggtgcaccataagatccacgatttcaggtggacggctctcggcatgctgccacatgaggaccctcagccacgctacctcaggccggtgtccaccgctgctacgctcaacttcgctgctacgctggctcagtctgctaggctctggaaggactacgatccgacattcgccgcggattgcctggagaaggctgagatcgcttggcaggctgctctcaagcacccagacatctacgccgagtacaccccaggcagcggcggccctggcggcggcccgtacaacgacgattacgtcggcgatgagttctactgggctgcttgcgagctctacgtgaccacgggcaaggacgagtacaagaactacctgatgaactcgcctcattacctggagatgccagctaagatgggcgagaacggcggcgctaacggcgaggacaacggcctgtggggctgcttcacatggggcacaacccagggcctcggcaccatcacgctcgctctggtcgagaacggcctgccagcgaccgatatccagaaggcccggaacaacatcgctaaggctgctgacaggtggctggagaacatcgaggagcagggctaccgcctccctatcaagcaggctgaggacgagaggggcggctacccgtggggcagcaactcgttcatcctcaaccagatgatcgtgatgggctacgcgtacgacttcacgggcaactctaagtacctggacggcatgcaggatggcatgtcctacctcctgggccgcaacggcctcgatcagagctacgtcaccggctacggcgagcgccccctgcagaacccacacgacaggttctggacacctcagacctccaagaagttcccagctccaccaccaggcatcatcgctggcggccccaacagcaggttcgaggacccaacaatcaccgccgcggtgaagaaggatacacctccgcagaagtgctacatcgaccataccgattcttggtccacaaacgagatcaccgtcaactggaacgctccattcgcttgggtgaccgcttacctcgacgagatcgatctgatcggctgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtaccaaatccatggaatcaaggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcgaacaaacatttgtccctctccctcttcctcgtcctccttggcctgtcggccagcttggcctccgggcaacaaacaagcattactctgacatccaacgcatccggtacgtttgacggttactattacgaactctggaaggatactggcaatacaacaatgacggtctacactcaaggtcgcttttcctgccagtggtcgaacatcaataacgcgttgtttaggaccgggaagaaatacaaccagaattggcagtctcttggcacaatccggatcacgtactctgcgacttacaacccaaacgggaactcctacttgtgtatctatggctggtctaccaacccattggtcgagttctacatcgttgagtcctgggggaactggagaccgcctggtgcctgcctggccgagggctcgctcgtcttggacgcggctaccgggcagagggtccctatcgaaaaggtgcgtccggggatggaagttttctccttgggacctgattacagactgtatcgggtgcccgttttggaggtccttgagagcggggttagggaagttgtgcgcctcagaactcggtcagggagaacgctggtgttgacaccagatcacccgcttttgacccccgaaggttggaaacctctttgtgacctcccgcttggaactccaattgcagtccccgcagaactgcctgtggcgggccacttggccccacctgaagaacgtgttacgctcctggctcttctgttgggggatgggaacacaaagctgtcgggtcggagaggtacacgtcctaatgccttcttctacagcaaaaaccccgaattgctcgcggcttatcgccggtgtgcagaagccttgggtgcaaaggtgaaagcatacgtccacccgactacgggggtggttacactcgcaaccctcgctccacgtcctggagctcaagatcctgtcaaacgcctcgttgtcgaggcgggaatggttgctaaagccgaagagaagagggtcccggaggaggtgtttcgttaccggcgtgaggcgttggcccttttcttgggccgtttgttctcgacagacggctctgttgaaaagaagaggatctcttattcaagtgccagtttgggactggcccaggatgtcgcacatctcttgctgcgccttggaattacatctcaactccgttcgagagggccacgggctcacgaggttcttatatcgggccgcgaggatattttgcggtttgctgaacttatcggaccctacctcttgggggccaagagggagagacttgcagcgctggaagctgaggcccgcaggcgtttgcctggacagggatggcacttgcggcttgttcttcctgccgtggcgtacagagtgggcgaggctgaaaggcgctcgggattttcgtggagtgaagccggtcggcgcgtcgcagttgcgggatcgtgtttgtcatctggactcaacctcaaattgcccagacgctacctttctcggcaccggttgtcgctgctcggtgaggcttttgccgaccctgggctggaagcgctcgcggaaggccaagtgctctgggaccctattgttgctgtcgaaccggccggtaaggcgagaacattcgacttgcgcgttccaccctttgcaaacttcgtgagcgaggacctggtggtgcataacaccgtccccctgggccaagtgacaatcgatggcgggacctacgacatctataggacgacacgcgtcaaccagccttccattgtggggacagccacgttcgatcagtactggagcgtgcgcacctctaagcggacttcaggaacagtgaccgtgaccgatcacttccgcgcctgggcgaaccggggcctgaacctcggcacaatagaccaaattacattgtgcgtggagggttaccaaagctctggatcagccaacatcacccagaacaccttctctcagggctcttcttccggcagttcgggtggctcatccggctccacaacgactactcgcatcgagtgtgagaacatgtccttgtccggaccctacgttagcaggatcaccaatccctttaatggtattgcgctgtacgccaacggagacacagcccgcgctaccgttaacttccccgcaagtcgcaactacaatttccgcctgcggggttgcggcaacaacaataatcttgcccgtgtggacctgaggatcgacggacggaccgtcgggaccttttattaccagggcacatacccctgggaggccccaattgacaatgtttatgtcagtgcggggagtcatacagtcgaaatcactgttactgcggataacggcacatgggacgtgtatgccgactacctggtgatacagagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 148 - DNA, 13675 bp, Artificial Sequence
  Synthetic construct 4124
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctttaccgatgggcactcgagatgcagaagatttactttcatccgactcgggtgcttcaggtgcttttgtcaatttagctcgaagcttctctaaagaaacacctctgtttacttcctctattaactcagctcgtgcagcttcatactcctccttttcttgctctggtgtgtatgactgctttccccttctttcccaccgaaggtaagcttggatctgcacaagatcctctggcaccaaggtagaagtagcagaagaggaggcaccagatgcaccagtaccctgatggcggctcgactggaactgaacctgaaaattctggccattgtttttaaaccatttgttctgtgtctcgtcaaagatgaggaactcaatggcgtgcaccccaggatcatctatctcaatccttagagtggagttatcacctgactttacaaaaggtgtcctgagagccctgttcttgtacactgtcgttccatcaggttttctggacgggaggaattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagtttcctcccgtccagaaaacctgatggaacgacagtgtacaagaacagggctctcaggacaccttttgtaaagtcaggtgataactccactctaaggattgagatagatgatcctggggtgcacgccattgagttcctcatctttgacgagacacagaacaaatggtttaaaaacaatggccagaattttcaggttcagttccagtcgagccgccatcagggtactggtgcatctggtgcctcctcttctgctacttctaccttggtgccagaggatcttgtgcagatccaagcttaccttcggtgggaaagaaggggaaagcagtcatacacaccagagcaagaaaaggaggagtatgaagctgcacgagctgagttaatagaggaagtaaacagaggtgtttctttagagaagcttcgagctaaattgacaaaagcacctgaagcacccgagtcggatgaaagtaaatcttctgcatctcgagtgcccatcggtaaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacctctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctaaaccatgcgcgtgctgctcgtggccctggccctgcttgctcttgccgctagcgccacctctcagaacgccgcctgggctcaatgcggcggcaacggctggaccggcagcaagacctgcgtgtccggctacaagtgcaccgtggtgaacgagtggtactcccagtgcatcccgggcaccgccgaggaacctaccaccaccctcaagaccaccaccggcggcggcagcaccccaaccggcaccccaggcaacggcaagttcctgtgggtgggcacgaacgaggctggcggcgagttcggcgagggcagcctgccaggcacctggggcaagcacttcatcttcccggacccagccgccgtggacaccctgatcagccagggctacaacgccttccgcgtccagctgcgcatggagcgcaccaacccgagcagcatgaccggccccttcgacaccgcctacctgaagaacctgaccaccatcgtggaccacatcaccggcaagggcgccaacgtgatcctggacccgcacaactacggccgctacttcgacaagatcatcaccagcaccagcgacttccagacctggtggaagaacttcgccactcagttcaagagcaacagcaaggtgatcttcgacaccaacaacgagtacaacaccatggaccagaccctggtgctgaacctgaaccaggccgccatcaacggcatcagggcagctggcgccacccagaccatcttcgtggagggcaaccagtggagcggcgcctggtcctggccagacgtgaacgacaacatgaaggccctgaccgacccgctggacaagatcgtgtacgagatgcaccagtacctggacagcgacagcagcggcaccagcccgaactgcgtgtccaccaccatcggcgtggagagggtgaaggccgccaccgagtggctgcgcaagaacaagaagatcggcatgatcggcgagctggctggcggcccaaacgacacctgcaagaccgccgtgaagaacatgctggactacctgaaggaaaacagcgatgtctggaagggcgtgacctggtgggccgctggcccatggtgggccgactacatgttcagcttcgagccgccaagcggcaccggctaccagtactacaacagcctgctcaagacctacatcagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtaccaaatccatggaatcaaggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcgaacaaacatttgtccctctccctcttcctcgtcctccttggcctgtcggccagcttggcctccggggcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacatcagggaatggatacctggctctctacggttggaccacaaacccgttggttgagtactatgttgtcgatagctggggctcctggcgccctcccggaagtgatgggacatttcttggcacagtgaactcagacggcggcacgtatgacatctacagggcgcaaagagtcaacgcaccgtgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaacagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggaattcctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatctaaaccatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 149 - DNA, 10248 bp, Artificial Sequence
  Synthetic construct 4125
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatccgaggtatgctatattccgagacttggccccaaccatttcctcagagaattcttcggctgatattgcatattttccaagaaatttcttcttggccaatgaaatagatggtactgcatggccaacttctgcatttggagaacttgattgctgaagttcactctctgtgatctccctataggttatatctgcagaagtaggcttgaaggaaaacagtttctgatcatatccttcaagttcagatagagtggtgtggtcaaaacaggtcgcaaacagtaccttgctattccttgctcggactgacacatgagacagaacatctggcatatcaggtgtaattacaccaactactccatctggtatttcttcctctcccttgacactctttgccacaaggatggttggtttatcataagatttgttctggacagcaagtaactcatcaaccacaaccacataacctgatacttcaaccgggcttataacctgccaacttccgaggtgagcaacattccttaaaacaggatcaaatcggttcagaagattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagttcttctgaaccgatttgatcctgttttaaggaatgttgctcacctcggaagttggcaggttataagcccggttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtctcatgtgtcagtccgagcaaggaatagcaaggtactgtttgcgacctgttttgaccacaccactctatctgaacttgaaggatatgatcagaaactgttttccttcaagcctacttctgcagatataacctatagggagatcacagagagtgaacttcagcaatcaagttctccaaatgcagaagttggccatgcagtaccatctatttcattggccaagaagaaatttcttggaaaatatgcaatatcagccgaagaattctctgaggaaatggttggggccaagtctcggaatatagcatacctccctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacctctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctaaaccatgcgcgtgctgctcgtggccctggccctgcttgctcttgccgctagcgccacctctcagaacgccgcctgggctcaatgcggcggcaacggctggaccggcagcaagacctgcgtgtccggctacaagtgcaccgtggtgaacgagtggtactcccagtgcatcccgggcaccgccgaggaacctaccaccaccctcaagaccaccaccggcggcggcagcaccccaaccggcaccccaggcaacggcaagttcctgtgggtgggcacgaacgaggctggcggcgagttcggcgagggcagcctgccaggcacctggggcaagcacttcatcttcccggacccagccgccgtggacaccctgatcagccagggctacaacgccttccgcgtccagctgcgcatggagcgcaccaacccgagcagcatgaccggccccttcgacaccgcctacctgaagaacctgaccaccatcgtggaccacatcaccggcaagggcgccaacgtgatcctggacccgcacaactacggccgctacttcgacaagatcatcaccagcaccagcgacttccagacctggtggaagaacttcgccactcagttcaagagcaacagcaaggtgatcttcgacaccaacaacgagtacaacaccatggaccagaccctggtgctgaacctgaaccaggccgccatcaacggcatcagggcagctggcgccacccagaccatcttcgtggagggcaaccagtggagcggcgcctggtcctggccagacgtgaacgacaacatgaaggccctgaccgacccgctggacaagatcgtgtacgagatgcaccagtacctggacagcgacagcagcggcaccagcccgaactgcgtgtccaccaccatcggcgtggagagggtgaaggccgccaccgagtggctgcgcaagaacaagaagatcggcatgatcggcgagctggctggcggcccaaacgacacctgcaagaccgccgtgaagaacatgctggactacctgaaggaaaacagcgatgtctggaagggcgtgacctggtgggccgctggcccatggtgggccgactacatgttcagcttcgagccgccaagcggcaccggctaccagtactacaacagcctgctcaagacctacatcagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtaccaaatccatggaatcaaggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcgaacaaacatttgtccctctccctcttcctcgtcctccttggcctgtcggccagcttggcctccggggcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacatcagggaatggatacctggctctctacggttggaccacaaacccgttggttgagtactatgttgtcgatagctggggctcctggcgccctcccggaagtgatgggacatttcttggcacagtgaactcagacggcggcacgtatgacatctacagggcgcaaagagtcaacgcaccgtgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaacagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 150 - DNA, 14355 bp, Artificial Sequence
  Synthetic construct 4514
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctttaccgatgggcactcgagatgcagaagatttactttcatccgactcgggtgcttcaggtgcttttgtcaatttagctcgaagcttctctaaagaaacacctctgtttacttcctctattaactcagctcgtgcagcttcatactcctccttttcttgctctggtgtgtatgactgctttccccttctttcccaccgaaggtaagcttggatctgcacaagatcctctggcaccaaggtagaagtagcagaagaggaggcaccagatgcaccagtaccctgatggcggctcgactggaactgaacctgaaaattctggccattgtttttaaaccatttgttctgtgtctcgtcaaagatgaggaactcaatggcgtgcaccccaggatcatctatctcaatccttagagtggagttatcacctgactttacaaaaggtgtcctgagagccctgttcttgtacactgtcgttccatcaggttttctggacgggaggaattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagtttcctcccgtccagaaaacctgatggaacgacagtgtacaagaacagggctctcaggacaccttttgtaaagtcaggtgataactccactctaaggattgagatagatgatcctggggtgcacgccattgagttcctcatctttgacgagacacagaacaaatggtttaaaaacaatggccagaattttcaggttcagttccagtcgagccgccatcagggtactggtgcatctggtgcctcctcttctgctacttctaccttggtgccagaggatcttgtgcagatccaagcttaccttcggtgggaaagaaggggaaagcagtcatacacaccagagcaagaaaaggaggagtatgaagctgcacgagctgagttaatagaggaagtaaacagaggtgtttctttagagaagcttcgagctaaattgacaaaagcacctgaagcacccgagtcggatgaaagtaaatcttctgcatctcgagtgcccatcggtaaacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgatcgcttcatgtctaactcgagttactggtacgtactgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacctctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctaaaccatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtaccaaatccatggaatcaaggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcgaacaaacatttgtccctctccctcttcctcgtcctccttggcctgtcggccagcttggcctccggggcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacatcagggaatggatacctggctctctacggttggaccacaaacccgttggttgagtactatgttgtcgatagctggggctcctggcgccctcccggaagtgatgggacatttcttggcacagtgaactcagacggcggcacgtatgacatctacagggcgcaaagagtcaacgcaccgtgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaacagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 151 - DNA, 14441 bp, Artificial Sequence
  Synthetic construct 4515
tctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatccgaggtatgctatattccgagacttggccccaaccatttcctcagagaattcttcggctgatattgcatattttccaagaaatttcttcttggccaatgaaatagatggtactgcatggccaacttctgcatttggagaacttgattgctgaagttcactctctgtgatctccctataggttatatctgcagaagtaggcttgaaggaaaacagtttctgatcatatccttcaagttcagatagagtggtgtggtcaaaacaggtcgcaaacagtaccttgctattccttgctcggactgacacatgagacagaacatctggcatatcaggtgtaattacaccaactactccatctggtatttcttcctctcccttgacactctttgccacaaggatggttggtttatcataagatttgttctggacagcaagtaactcatcaaccacaaccacataacctgatacttcaaccgggcttataacctgccaacttccgaggtgagcaacattccttaaaacaggatcaaatcggttcagaagattcgaagaaggtacagtacacacacatgtatatatgtatgatgtatcccttcgatcgaaggcatgccttggtataatcactgagtagtcattttattactttgttttgacaagtcagtagttcatccatttgtcccattttttcagcttggaagtttggttgcactggcacttggtctaataactgagtagtcattttattacgttgtttcgacaagtcagtagctcatccatctgtcccattttttcagctaggaagtttggttgcactggccttggactaataactgattagtcattttattacattgtttcgacaagtcagtagctcatccatctgtcccatttttcagctaggaagttcttctgaaccgatttgatcctgttttaaggaatgttgctcacctcggaagttggcaggttataagcccggttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtctcatgtgtcagtccgagcaaggaatagcaaggtactgtttgcgacctgttttgaccacaccactctatctgaacttgaaggatatgatcagaaactgttttccttcaagcctacttctgcagatataacctatagggagatcacagagagtgaacttcagcaatcaagttctccaaatgcagaagttggccatgcagtaccatctatttcattggccaagaagaaatttcttggaaaatatgcaatatcagccgaagaattctctgaggaaatggttggggccaagtctcggaatatagcatacctccctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgatcgcttcatgtctaactcgagttactggtacgtactgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacctctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccggatcctaaaccatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgtacgtaccaaatccatggaatcaaggtaccctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatggcgaacaaacatttgtccctctccctcttcctcgtcctccttggcctgtcggccagcttggcctccggggcccaaacatgtctgaccagcccacaaacaggattccacaacggcttcttttactcgttttggaaagattctcctggtactgttaacttttgccttcttgaagggggaagatatacctccaattggtctgggataaacaattgggtcggtggcaagggctggcagaccggtagtaggcgcaacatcacgtattccgggagcttcaatacatcagggaatggatacctggctctctacggttggaccacaaacccgttggttgagtactatgttgtcgatagctggggctcctggcgccctcccggaagtgatgggacatttcttggcacagtgaactcagacggcggcacgtatgacatctacagggcgcaaagagtcaacgcaccgtgcttcgctaaggacactaaggtctactacgagaatgacacactggttcatttcgagtcaattgaggacatgtaccataagtacgcttctctcgggagggaggtgccattcgacaacggctacgctgtcccactggagaccgtgtcagtctacacgttcgatccgaagacaggcgaggttaagaggacgaaggctagctacatctaccgggagaaggtggagaagctcgccgagatccgcctgtcgaacggctacctcctgaggattacactcctgcaccccgttctcgtgttccggaatggcctgcagtgggtgccagctggcatgatcaagcctggggacctcatcgtcggcattcgctcggttccagcgaacgccgcgactattgaggagtctgaggcctacttcctcgggctgttcgtggctgagggcacctcaaatcctctctccatcaccacgggctccgaggagctgaaggacttcatcgtcagcttcattgaggaccatgatgggtacacaccaactgtcgaggttcgcaggggcctctaccggatcctgttccgcaagaagacggctgagtggctcggcgagctggctacttcgaacgcctctaccaaggtggtccctgagagggtcctcaatgcgggggagtccgctatcgctgccttcctcgctggctacctggacggcgatgggtacctcactgagtctattgtggagctggtcaccaagtcacgggagctcgctgacgggctggtgttcctcctgaagcgcctgggcatcacgccgaggattagccagaagacaatcgaggggtcggtctactaccggatctacattacgggcgaggatcgcaagacattcgagaaggtcctggagaagtccaggatcaagccaggggagatgaacgagggcggggttggcaggtacccaccagctctgggcaagttcctcgggaagctgtacagcgagttcaggctccccaagcgggacaacgagactgcgtaccacatcctgaccaggtcacggaatgtgtggttcaccgagaagacgctctcccggattgaggagtacttcagggaggctctggagaagctgtcggaggctaggaaggctctggagatgggcgacaagccggagctgccattcccttggacagcgatcactaagtacgggttcacggatcgccaggtcgctaactacaggacaaggggcctcccaaagaggccagagctgaaggagaaggttgtgtccgccctcctgaaggagatcgagaggctggagggcgtggctaagctcgctctggagaccattgagctcgctaggcgcctggagttccatgaggtttccagcgtggaggtcgttgactacaatgattgggtctacgatctcgtcattccagagactcataacttcattgctccaaatgggctcgtgctccacaacagcatcattggcaatgccaccttctaccagtattggtccgtgcggcagtccaagcgtgtcggtgggacaatcacgactggcaaccacttcgacgcgtgggccagcgtgggcctcaacctcgggactcataactaccagataatggctactgagggttaccagtcgtcaggatcttcagacattacggtgtcaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

SEQ ID NO: 152 - DNA, 11 bp, Artificial Sequence
  Synthetic construct, ZmGWD1 intron splicing site
aaaggaggagt

SEQ ID NO: 153 - DNA, 20 bp, Artificial Sequence
  Synthetic construct, GWD forward primer
atgaaggagacaagcgttgg

SEQ ID NO: 154 - DNA, 20 bp, Artificial Sequence
  Synthetic construct, GWD reverse primer
aagtttcaccttgcgtgtgc

SEQ ID NO: 155 - DNA, 20 bp, Artificial Sequence
  Synthetic construct, beta-actin forward primer
caactgcccagcaatgtatg

SEQ ID NO: 156 - DNA, 20 bp, Artificial Sequence
  Synthetic construct, beta-actin reverse primer
cgtagatagggacggtgtgg

SEQ ID NO: 157 - DNA, 20 bp, Artificial Sequence
  Synthetic construct, GADPH forward primer
cgctgagtatgtcgtggagt

SEQ ID NO: 158 - DNA, 20 bp, Artificial Sequence
  Synthetic construct GADPH reverse primer
aacaaccttcttggcaccac

SEQ ID NO: 159 - RNA, 255 nt, Oryza sativa
  misc_feature (1)..(255): osa-MIR528
gaucccagcagcagccacagcaaaauuugguuugggauagguagguguuauguuaggucugguuuuuuggcuguagcagcagcaguggaaggggcaugcagaggagcaggagauucaguuugaagcuggacuucacuuuugccucucucuccugugcuugccucuuccauuccugcugcuaggcuguucuguggaaguuugcagaguuuauauuauggguuuaaucguccauggcaucagcaucagcagcgguac

SEQ ID NO: 160 - protein, 587 aa, Artificial Sequence
  Amylase 19862 protein
LTPAEWRSQSIYFLLTDRFGRTDNSTTAACDTTDRVYCGGSWQGIINHLDYIQGMGFTAIWITPVTGQFYENTGDGTSYHGYWQQDIYDLNYNYGTAQDLKNLASALHERGMYLMVDVVANHMGYDGAGNTVDYSVFNPFSSSSYFHPYCLISNYDNQTNVEDCWLGDTTVSLPDLDTTSTAVRDIWYDWVADLVANYSIDGLRVDTVKHVEKDFWPDYNSAAGVYCVGEVFSGDPAYTCPYQNYMDGVLNYPIYYQLLYAFESSSGSISDLYNMISSVASSCKDPTLLGNFIENHDNPRFASYTSDYSQAKNVITFIFLSDGIPIVYAGQEQHYSGGSDPANREATWLSGYSTSATLYTWIASTNQIRSLAISKDAGYVQAKNNPFYSDSNTIAMRKGTTAGAQVITVLSNKGASGSSYTLSLSGTGYSAGATLVETYTCTTVTVDSSGNLPVPMTSGLPRVFVPSSWVNGSALCNTECTAATSLPVLFEELVTTTYGENIYLSGSISQLGSWNTASAVALSASQYTSSNPKWYVSVTLPVGTSFQYKFIKKGSDGSVVWESDPNRSYTVPAGCEGATVTVADTWR

SEQ ID NO: 161 - protein, 619 aa, Artificial Sequence
  Glucoamylase 20082 protein
APQLSPRATTSLDAWLASETTVSLNGILDNIGASGAYAQSAKAGVVIASPSTSSPDYYYTWTRDSALTLKVLIDLFRNGNVDLQTVIEEYITAQAYLQTVSNPSGDLSSGAGLAEPKFNVDMSAYTGAWGRPQRDGPALRAIALIDFGNWLIDNGYSSYAVSNVWPIVRNDLSYVAQYWSQSGYDLWEEVNSMSFFTIANQHRALVEGSTFAGRVGASCSWCDSQAPQILCYMQNFWTGSYINANTGGGRSGKDANTVLASISTFDPEATCDDVTFQPCSSRALANHKVYTDSFRSVYSLDSGIAEGVAVAVGRYPEDSYYNGNPWFLTTLAAAEQLYDAIYQWNKIGSITITSTSLAFFNDVYSSAAVGTYASGSTAYTAIVSAVKTYADGYVSIVQAHAMTNGSLSEQFDKASGTQLSARDLTWSYAALLTANMRRNGIVPPSWGAASANSIPSSCSTGSATGTYSTPTGTSWPSTLTSGTAGTTTTSATTTTSTSVSKTTTTTTSTTSCTTPTSVAVTFDEIATTYYGENVYISGSISQLGSWDTSSAIALSASQYTSSNNLWFVTINLPAGTTFQYKYIRKESDGSIVWESDPNRSYTVPSGCGVSTATESDTWR

SEQ ID NO: 162 - protein, 616 aa, Artificial Sequence
  Glucoamylase 20707 protein
EAAPQLAPRATTSLDAWLASETTVALDGILDNVGSSGAYAKSAKSGIVIASPSTDNPDYYYTWTRDAALTVKALIDLFRNGETSLQTVIMEYISSQAYLQTVSNPSGSLSTGGLAEPKYYVDETAYTGSWGRPQRDGPALRATAMIDFGNWLIDNGYSTYASNIVWPIVRNDLSYVAQYWNQTGYDLWEEVNGSSFFTIAVQHRALVEGSTFASKVGASCSWCDSQAPQVLCFLQRFWTGSYIMANFGGGRSGKDANTVLGSIHTFDPNAGCDDTTFQPCSPRALANHKVYTDSFRSIYSINSGISQGKAVAVGRYPEDSYYNGNPWFLTTLAAAEQLYDAIYQWQKIGSITITDVSLAFFKDLYSSAAVGTYASSSSAFTSIVNAVKTYADGYMSIVQTHAMTNGSLSEQFGKSDGFSLSARDLTWSYAALLTANLRRNSVVPPSWGETTATSVPSVCSATSATGTYSTATNTAWPSTLTSGTGATTTTSKATSTTTTSSASTTTAGCVVPTAVAVTFDEIATTTYGENVYVVGSISQLGSWDTSKAVALSASKYTSSNNLWYATVTLPAGTTFQYKFIRVSSSGTVTWESDPNRSYTVPSACGTSTAVVNTTWR

SEQ ID NO: 163 - protein, 569 aa, Artificial Sequence
  Amylase 21853 protein
ADTNAWKSRSIYFVLTDRIARNSSDTGGSACSDLGNYCGGTFQGLESKLDYIKGLGFDAIWITPVVSNKAAGYHGYWAEDLYAVNSNYGTAADLKSLVAAAHAKGIYMMVDVVANHMGPGAITNNRPEPLNQASSYHPPCNIDYNNQTSVEVCQIAGLPDIYTTKSEIRTLLNTWVNWLVNEYSFDGVRIDTVKHVEKDFWPGFSAATGVYNIGEVFDGDPAYLAPYAKLMPGLLNYAVYYPMNNFYQQTGSSQALVDMMNTVSNTFPDPSALGTFLDNHDNKRWLNVKNDQTLLKNALAYVILARGIPILYYGTEQGYAGGDDPANREDLWRSGFNTNANLYQAIKKLTAARQAAGGLAGNDHVHLYVADTAYAWSRANGNLIVLTTNAGGNSNTQHCFNTQKANGRWTNVYGNGATVSADSNGQICVSVTNGEPVVLLAGSATPTTGTTLSTRTATATATPTACPTAVSVSFTHRVTTVPGDTIKITGNTAQLGNWTPANGLALSAASYTSSNPIWTITVPLAAGSSISYKFVKIDSGGTVTWESDPNRSYTAPSCQASASVNSSWQ

SEQ ID NO: 164 - DNA, 1764 bp, Artificial Sequence
  Amylase 19862 coding sequence
cttactccagctgagtggaggtctcagagcatctacttcctcctcactgatcgcttcggcaggaccgataactctactaccgctgcttgcgataccactgatagggtttactgcggcggctcttggcagggcatcatcaaccacctggattacatccagggcatgggcttcactgctatctggatcactccagtgactggccagttctacgagaacactggcgatggcacttcataccacggctactggcagcaggatatctacgacctgaactacaactacggcactgctcaggatcttaagaacctggcttctgctcttcacgagaggggcatgtacctgatggtggatgtggtggctaaccacatgggctacgatggcgctggcaacactgtggattactccgtgttcaacccattcagcagcagctcttacttccacccgtactgcctgatcagcaactacgacaaccagaccaacgttgaggattgctggcttggcgatacaaccgtgtctctgccagacctggataccacttctactgctgtgagggatatctggtatgattgggtggccgatcttgtggctaactactctatcgatggcctgagggtggacactgttaagcacgtggagaaggatttctggccagactacaactctgctgctggcgtttactgtgttggggaggttttctctggcgatccagcttacacttgcccgtaccagaactacatggatggcgtgctgaactacccaatctactaccagctcctgtacgctttcgagtcaagctctggctctatcagcgacctgtacaacatgatcagcagcgtggcttcttcttgcaaggacccaacccttcttggcaactttatcgagaaccacgacaacccacgcttcgctagctacaccagcgattactctcaggccaagaacgtgatcaccttcatcttcctctcagacggcatcccaatcgtttacgctggccaggagcagcattactctggcggctctgatccagctaaccgcgaggctacttggctttctggctactctacctctgctaccctgtacacttggatcgctagcactaaccagatccgctcactggctatctctaaggatgctggctacgtccaggctaagaacaacccattctactccgactctaacaccatcgctatgaggaagggcactactgctggcgctcaggtgatcactgtgctgtctaacaagggcgcttctggctcttcttacaccctttctctgtctggcactggctactctgctggcgctactcttgtggagacctacacctgcaccactgtgaccgttgattcttctggcaacctgccagtgccaatgacttctggccttccaagggtgttcgttccaagctcttgggttaacggctctgctctgtgcaacactgagtgcactgctgctacttctctgccagtgctgttcgaggagctggtgactactacttacggcgagaacatctaccttagcggctctatctctcagcttggctcttggaacactgcttctgctgtggctctttctgctagccagtacaccagctctaacccaaagtggtacgtgtctgtgactcttccagtgggcactagcttccagtacaagtttatcaagaagggctctgacggctctgttgtttgggagagcgacccaaacaggtcttacactgttccagctggctgcgagggcgctactgttactgttgccgatacctggcgctga

SEQ ID NO: 165 - DNA, 1860 bp, Artificial Sequence
  Glucoamylase 20082 coding sequence
gccccacagctttctccaagggctaccacctctcttgatgcttggctggcttctgagaccactgttagcctgaacgggattcttgataatatcggcgcttcaggcgcttacgctcagtctgctaaggctggcgttgttatcgctagcccaagcacctctagcccagactactactacacctggaccagggattctgctctgacccttaaggtgctgatcgaccttttcaggaacggcaacgttgatcttcagaccgtgatcgaggagtacatcactgctcaggcttaccttcagactgtgagcaacccatctggcgatctttcttcaggcgctggccttgccgagccaaagttcaacgtggacatgtctgcttacactggcgcttggggcaggccacagagggatggcccagctcttagggctatcgcccttatcgatttcggcaactggcttatcgataacggctactctagctacgctgtgtctaatgtgtggccaattgtgaggaacgatctgtcttacgtggctcagtactggtctcagtctggctacgatctttgggaggaggtgaacagcatgtctttcttcaccatcgctaaccagcacagggctcttgttgagggctctactttcgctggcagagttggcgcttcttgctcttggtgcgattctcaggctccacagatcctttgctacatgcagaatttctggaccggctcttacatcaacgctaacactggcggcggccgctctggcaaggatgctaacaccgtgctggctagcatctctactttcgacccagaggctacttgcgatgatgtgaccttccagccatgctcttctagggctctggctaaccacaaggtgtacaccgattctttccgctctgtgtactctcttgactctgggatcgctgagggcgttgctgttgctgttggccgctacccagaggattcttactacaacggcaacccgtggttccttactactcttgctgctgccgagcagctttacgacgctatctaccagtggaacaagatcggctctatcaccatcacctctacctcactggctttcttcaacgacgtgtactcttctgctgctgttggcacttacgcttcaggctctaccgcttacactgctatcgtgtccgctgttaagacttacgctgacggctacgtgtctatcgttcaggctcacgctatgactaacggctctctgtctgagcagttcgataaggcttctggcactcagctttctgctagggatctgacctggtcttacgctgctctgctgactgctaacatgaggcgcaacggcatcgttccaccatcttggggcgctgcttcagctaactctatcccaagctcttgctctactggctctgctactggcacttactctaccccaactggcacttcttggccatctactctgacttcaggcactgctggcaccactactacctctgctaccaccaccacctctactagcgtgtctaagaccaccaccactaccacttctactaccagctgcaccactccaacttcagtggctgtgaccttcgatgagatcgctaccacttactacggcgagaacgtgtacatcagcggctctatctctcagcttggcagctgggatacttcttctgccatcgccctttctgcttctcagtacaccagcagcaacaacctgtggttcgtgaccatcaaccttccagctggcactactttccagtacaagtatatcaggaaggagtctgacggctctatcgtttgggagagcgacccaaacaggtcttacactgtgccatctggctgcggcgtttctactgctaccgagagcgatacttggcgctaa

SEQ ID NO: 166 - DNA, 1851 bp, Artificial Sequence
  Glucoamylase 20707 coding sequence
gaggctgctccacagcttgctccaagggctactacctctctggatgcttggcttgcttctgagaccactgttgctctggatgggattcttgataatgttggctcttctggcgcttacgctaagtctgctaagtcaggcatcgtgatcgcttctccatctaccgacaacccggactactactacacttggaccagggatgctgctcttactgtgaaggccctgatcgatcttttcaggaacggcgagacctctcttcagactgtgatcatggagtacatcagctctcaggcttacctccagactgtgtctaacccatctggctcactttctactggcggccttgccgagccaaagtactacgtggatgagactgcttacactggctcttggggcaggccacagagggatggcccagctcttagggctactgccatgatcgatttcggcaactggcttatcgataacggctactctacctacgctagcaacattgtgtggccaattgtgaggaacgatctgtcttacgtggctcagtactggaaccagactggctacgatctttgggaggaggttaacggctctagcttcttcactatcgccgttcagcacagggctcttgttgagggctctaccttcgcttctaaggttggggcttcttgctcttggtgcgattctcaggctccacaggttctgtgcttccttcagaggttctggactggctcttacatcatggctaacttcggcggcggccgctctggcaaggacgctaacactgtgctgggctctatccacactttcgatccaaacgctggctgcgacgatacaactttccagccatgctctccaagggctctggctaaccacaaggtgtacaccgatagcttccgctctatctactctatcaacagcggcatctctcagggcaaggctgttgctgttggccgctacccagaggattcttactacaacggcaacccgtggttccttactactcttgctgctgccgagcagctttacgatgctatctaccagtggcagaagatcggctctatcaccatcactgacgtgtctctggccttcttcaaggacctgtactcttctgctgctgttggcacctacgcttctagctcttctgccttcacctctatcgtgaacgccgttaagacttacgctgacggctacatgtctatcgttcagacccacgctatgactaacggctctctgtctgagcagttcggcaagtctgatggcttctctctgtctgctagggatctgacttggtcttacgctgctctgctgactgctaaccttaggcgcaactctgttgttccaccatcttggggcgagactactgctacttctgtgccatctgtgtgctctgctacttcagctaccggcacctactctaccgctactaacactgcttggccatctactctgacatctggcactggcgctaccactactacctctaaggctacctctaccaccactaccagctctgcttctactactactgctggctgcgttgttccaactgctgtggctgtgaccttcgacgagatcgctactactacttacggcgagaacgtgtacgttgtgggctctatctctcagcttggcagctgggatacttctaaggctgtggccctgtctgcttctaagtacaccagcagcaacaacctttggtacgctaccgttactcttccagctggcaccactttccagtacaagtttatcagggtgtcatcttcaggcactgtgacctgggagtctgatccaaacaggtcttacaccgtgccatctgcttgcggcacttctactgctgtggtgaacaccacttggcgctaa

SEQ ID NO: 167 - DNA, 1710 bp, Artificial Sequence
  Amylase 21853 coding sequence
gccgatacaaacgcttggaagagccgctctatctacttcgtgctgaccgataggatcgctaggaactcttctgatactggcggctctgcttgctctgatcttggcaactactgcggcggcactttccagggccttgagagcaagctggattacatcaagggccttggcttcgatgctatctggatcactccagtggtgtctaacaaggctgctggctaccacggctactgggctgaggatctgtacgctgtgaactctaactacggcactgctgctgatctgaagtctctggtggctgctgctcacgctaagggcatctacatgatggtggacgtggtggctaaccacatgggcccaggcgctatcactaacaacaggccagagccacttaaccaggcttcaagctaccatccaccgtgcaacatcgactacaacaaccagacttctgtggaggtttgccagatcgctggccttccagatatctacaccaccaagagcgagatcaggactctgctgaacacttgggtgaactggcttgtgaacgagtactctttcgatggcgtcaggatcgataccgttaagcacgtggagaaggatttctggccaggcttctctgctgctactggcgtttacaacatcggcgaggtgttcgatggcgatccagcttaccttgctccatacgccaagctgatgccaggccttcttaactacgccgtgtactacccgatgaacaacttctaccagcagactggctcttctcaggctctggtggacatgatgaacaccgtgtccaacactttcccagatccctctgctcttggcaccttcctggacaaccacgataacaagcggtggctgaacgtgaagaacgatcagaccctgctgaagaacgctctggcttacgttatccttgctaggggcatcccaatcctttactacggcacagagcagggctacgctggcggcgatgatccagctaaccgcgaggatctttggcgctctggcttcaacactaacgccaacctgtaccaggctatcaagaagctgactgctgctaggcaggctgctggcggccttgctggcaacgatcacgtccacctgtacgtggctgatactgcttacgcttggtctagggctaacggcaacctgatcgtgcttactactaacgctggcggcaactctaacactcagcactgcttcaacacccagaaggctaacggccgctggactaacgtttacggcaacggcgctactgtttctgctgatagcaacggccaaatctgcgtgtctgttactaacggcgagccagtggttcttcttgctggctctgctactccaactactggcaccaccctgtctactaggactgctaccgctactgctacaccaactgcttgcccaaccgctgtgtctgtgtctttcacccacagggtgacaactgttccaggcgacacgatcaagatcactggcaacactgcccagcttggcaactggactccagctaacggccttgctctttctgctgctagctacaccagctctaacccaatctggaccatcactgtgccacttgctgctggctctagcatcagctacaagttcgtgaagatcgattctggcggcactgttacttgggagagcgacccaaacaggtcttacactgctccatcttgccaggcttcagctagcgttaacagcagctggcagtaa

SEQ ID NO: 168 - DNA, 1449 bp, Bacillus licheniformis
  misc_feature (1)..(1449): AmyS coding sequence
gctaacctgaacggcactttgatgcagtatttcgagtggtatatgccaaacgacgggcaacactggaagagacttcagaacgactccgcttatttggccgaacacggtattaccgccgtctggataccccctgcttacaagggaacctctcaagcagacgtcggctacggagcttacgacctgtacgatctcggcgagtttcaccagaaaggaactgttagaactaagtacggaacgaaaggcgaattgcaatcagcgattaagtcgctgcacagcagggatatcaacgtgtacggtgacgttgttatcaatcacaagggtggagcagatgccacagaggacgtgacggcagtggaggttgatccggcggaccgcaaccgggtgatctccggcgaacacagaattaaagcatggactcacttccactttccagggaggggttctacgtactcagatttcaagtggcattggtatcacttcgacggcacagactgggacgagtcgagaaaacttaatcggatctacaaatttcaaggaaaggcctgggactgggaagtcagcaacgagaacggcaattatgattacttgatgtacgcagacatcgattacgatcaccccgatgttgcggctgagattaagcggtgggggacctggtacgccaacgaactccagctcgacggtttcaggcttgatgccgtgaaacatatcaagttttccttcttgcgcgactgggtcaatcacgtgcgggaaaagactggaaaagaaatgttcacggttgcagagtattggcaaaacgatctgggcgcgttggagaactatttgaacaagacaaactttaatcactctgttttcgacgtgcctctgcactaccagtttcacgctgcctcaacccaagggggaggctatgatatgcgcaaattgttgaactctactgtcgtcagcaaacacccgttgaaggccgtgactttcgttgataatcacgacacgcagccaggacagtccctggaaagcacggttcaaacctggttcaagcccctcgcgtacgcttttattttgaccagggagtcaggctatcctcaggtgttctatggggatatgtacgggactaaaggagacagccaaagagaaatcccggccctgaagcacaagattgagccaatcctcaaagctaggaagcagtacgcgtacggggcacagcacgattattttgatcaccacgacatcgttgggtggacacgcgaaggtgattcgtccgtcgccaactctggtcttgcagcactcattaccgacggacccggaggggcgaagcggatgtacgtgggtagacaaaacgccggcgaaacttggcacgatattacgggaaacaggtcagagcctgtggttattaacagcgaagggtggggggaatttcacgtgaatggaggctccgtttcgatctacgtccagcgc

SEQ ID NO: 169 - protein, 483 aa, Bacillus licheniformis
  MISC_FEATURE (1)..(483): AmyS protein
ANLNGTLMQYFEWYMPNDGQHWKRLQNDSAYLAEHGITAVWIPPAYKGTSQADVGYGAYDLYDLGEFHQKGTVRTKYGTKGELQSAIKSLHSRDINVYGDVVINHKGGADATEDVTAVEVDPADRNRVISGEHRIKAWTHFHFPGRGSTYSDFKWHWYHFDGTDWDESRKLNRIYKFQGKAWDWEVSNENGNYDYLMYADIDYDHPDVAAEIKRWGTWYANELQLDGFRLDAVKHIKFSFLRDWVNHVREKTGKEMFTVAEYWQNDLGALENYLNKTNFNHSVFDVPLHYQFHAASTQGGGYDMRKLLNSTVVSKHPLKAVTFVDNHDTQPGQSLESTVQTWFKPLAYAFILTRESGYPQVFYGDMYGTKGDSQREIPALKHKIEPILKARKQYAYGAQHDYFDHHDIVGWTREGDSSVANSGLAALITDGPGGAKRMYVGRQNAGETWHDITGNRSEPVVINSEGWGEFHVNGGSVSIYVQR

SEQ ID NO: 170 - DNA, 1851 bp, Aspergillus niger
  misc_feature (1)..(1851): GlaA coding sequence
gcgaccttggattcatggttgagcaacgaagcgaccgtggctcgtactgccatcctgaataacatcggggcggacggtgcttgggtgtcgggcgcggactctggcattgtcgttgctagtcccagcacggataacccggactacttctacacctggactcgcgactctggtctcgtcctcaagaccctcgtcgatctcttccgaaatggagataccagtctcctctccaccattgagaactacatctccgcccaggcaattgtccagggtatcagtaacccctctggtgatctgtccagcggcgctggtctcggtgaacccaagttcaatgtcgatgagactgcctacactggttcttggggacggccgcagcgagatggtccggctctgagagcaactgctatgatcggcttcgggcagtggctgcttgacaatggctacaccagcaccgcaacggacattgtttggcccctcgttaggaacgacctgtcgtatgtggctcaatactggaaccagacaggatatgatctctgggaagaagtcaatggctcgtctttctttacgattgctgtgcaacaccgcgcccttgtcgaaggtagtgccttcgcgacggccgtcggctcgtcctgctcctggtgtgattctcaggcacccgaaattctctgctacctgcagtccttctggaccggcagcttcattctggccaacttcgatagcagccgttccggcaaggacgcaaacaccctcctgggaagcatccacacctttgatcctgaggccgcatgcgacgactccaccttccagccctgctccccgcgcgcgctcgccaaccacaaggaggttgtagactctttccgctcaatctataccctcaacgatggtctcagtgacagcgaggctgttgcggtgggtcggtaccctgaggacacgtactacaacggcaacccgtggttcctgtgcaccttggctgccgcagagcagttgtacgatgctctataccagtgggacaagcaggggtcgttggaggtcacagatgtgtcgctggacttcttcaaggcactgtacagcgatgctgctactggcacctactcttcgtccagttcgacttatagtagcattgtagatgccgtgaagactttcgccgatggcttcgtctctattgtggaaactcacgccgcaagcaacggctccatgtccgagcaatacgacaagtctgatggcgagcagctttccgctcgcgacctgacctggtcttatgctgctctgctgaccgccaacaaccgtcgtaactccgtcgtgcctgcttcttggggcgagacctctgccagcagcgtgcccggcacctgtgcggccacatctgccattggtacctacagcagtgtgactgtcacctcgtggccgagtatcgtggctactggcggcaccactacgacggctacccccactggatccggcagcgtgacctcgaccagcaagaccaccgcgactgctagcaagaccagcaccagtacgtcatcaacctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctggcggtag

SEQ ID NO: 171 - protein, 616 aa, Aspergillus niger
  MISC_FEATURE (1)..(616): GlaA protein
ATLDSWLSNEATVARTAILNNIGADGAWVSGADSGIVVASPSTDNPDYFYTWTRDSGLVLKTLVDLFRNGDTSLLSTIENYISAQAIVQGISNPSGDLSSGAGLGEPKFNVDETAYTGSWGRPQRDGPALRATAMIGFGQWLLDNGYTSTATDIVWPLVRNDLSYVAQYWNQTGYDLWEEVNGSSFFTIAVQHRALVEGSAFATAVGSSCSWCDSQAPEILCYLQSFWTGSFILANFDSSRSGKDANTLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDAATGTYSSSSSTYSSIVDAVKTFADGFVSIVETHAASNGSMSEQYDKSDGEQLSARDLTWSYAALLTANNRRNSVVPASWGETSASSVPGTCAATSAIGTYSSVTVTSWPSIVATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 172 - DNA, 538 bp, Oryza sativa
  misc_feature (1)..(538): An inverted complement of OsDSP1
atgaactgcctccagaacctgctcaaggagcctccaatcgtgggatccaggtccatgaggcggccctcgccgctcaatctgacgatggttcgtggcgggagtcgccgatcaaacactgtcaaaaccgcatccggggcgtctacttctagcgcccagagtggcgcagtggaggcgggcacggagaaatccgatacgtacagcaccaacatgacgcaagctatgggagcagtgttgacgtatagacatgagcttggaatgaactacaatttcatacgcccagacttgatcgtgggctcctgcttacagagcccacttgatgttgataaacttagggacattggtgtaaaaacagtattctgcctgcagcaagatccagaccttgaatattttggagttgacatctgtgccattcaagaatattgtctacaatgtaaagatatagagcactgtcgtgccgaaattagggattttgatgcttttgatttgcgattgaggcttcctgctgtgattagcaaactgcacaagcttgtcaaccata

SEQ ID NO: 173 - DNA, 14001 bp, Oryza sativa
  misc_feature (1)..(14001): GWD gene Os06g30310
ttggcatggttgaagtcaagcgaaatatgacaacggcgaggcgccgacgatgatggagaccgacctaatgcatcccgacggcacggcagagagcgagatgcacttctcatgcttgccgtcgcgatttgcctcacaacttgtttggcaacttaaggaaagatgattggaagtttagatcaagaaattgatggtgagaataacatgagaatttggtttttagtcccattttcttattttataaaggcggtgggaattaacagggagtttagttgaagactagatcttaaatgaaatcagatggcttagatttgtttaggtaatgtaaaggaggaatttcctggccaagccaccccggcccagccctgctcctctttttcctactcccgactagggttcgttcggttgatggatattgaaattaggggggagtgcaggtgagagttgccctggggggccatatcagcgctagcgtaaattgtgctgagatgcctaagctcagcgccattatggctagcgctgagatcgaggagccagggaagcaaagcttcgagcggagtgccgaacctcagtgctagtgtaaatggcgttgagatagctaagctcaacgtcattacggctgacgctgagatcgcggatccaaagtagtccaggtgtaagttgctaagtgctgaacctagtgccagaaaaaatggcgctaaggtctgccattccaacgccaagtcatttggagctgaggtccttgccacgtaggccaggggaaggctgggccgcctccctggcaggtgttagcgccaaacactctagcattgagcacacggcttatttttagtttaagttttttacgcgggctaatttataaataagtttttcaaaagagccaatatttcgtactaaccaaacaaaatatttaatagttttatccctctaaattattaatccctacttaaaagctgctcacaaccaaacacaccctagcgcggttacagggagagaagaggggaaaatgaatggctgagagagcgatgatagattgaccggtgaagagaaaaaggtggacccactatatgagatggagcgtccgatatttctcggtgcaccggacgttttcgtttttttaagcgttttcgtttttgtttattttcgatataggaaggagagatatccatccggatcccggaagccgaatccatccatccatccatcccatactgcccttacgatcgagctgtttgatattcgtgcagatgagcggattctccgcggcagctgctgcggccgagcggtgcgcgctcggcctcggcgtccacgcgcgccccgcctcgccctcgccggcgctgctcccgccggcggctctccgccgcggccgccgcctccccgcggccaccaccaccctcgccgtctcccgtcggagcctcctcgcccctcgcgccatcgccgcttccaccggccgcgcctccccgggcgtacgcgctttttctcgctctatcgtgcccgccacgtgttcgacggtgtgactcactctctctctatgcttctgtttgtttgcagcttgtcggaaggttcaccctggatgccaactccgagcttaaggtgctgctgatctaccatgcattttgtggggggcgggttcacctggatcgaccaatttgatgtgatttttgttcgttctaatggagcatatgctgcataaatttttgcaaacacaggtgacattgaacccagcaccgcagggttcggtggtggagatcaatctagaggcaactaacaccagcggctccctgatactgcattggggcgcccttcgcccggatagagggtgagacttatcttctgtccctgttgatgactagtgcgtgcgtgcatgcccaatatcaatatatgcttctgtgttacatgttttgtatattttcgatttaaggcttggtaatccctaacaaagctttttgactgtacttagagaatggctcctaccatcccggaaaccagatggcacgacagtgtacaagaacagggctcttaggacgccttttataaaggtcagtcttgcatgacggatctgtcttgcaatgtaagtgcacatggttagtaatttctattcctgtctcgaatttcagtcaggtgataactccacgctgaaaattgagatagatgatcctgcagtgcaagccattgagttcctcatatttgatgaggcacggaataattggtcagttctttttgggttacccatcctaccctgtttcttggaatgcagaagatatcaaataacaacactctactttggacaggtacaaaaacaatggccagaatttccaaattcagctacaagcgagccaatatcaagggcagggtacatctactgctacttcttctactgtggttccagaggatcttgtgcagatacaatcatatcttcggtgggaaagaaagggaaagcagtcatatacacctgagcaagagaaggcatgtcctgttttttaatatatgtcacgttgacttttattataaactttgaccattcgttttattcaaaagttttgtgcaaatcttaaaaatataaatattgcttaaggtttcttagtgataaatcaagccacaacaaaaaaaaagatatttacttcaattttttaaataagatgaatggtcaaacatgatgtaaaaattcaatggcgtcatatattgaaaaacggagatagtactagttttggtttgccttatacaactcaatggactaactcattatttatgtggttttctctaggaggagtatgaagcagcacgaactgagttgatagaggaattaaacaagggtgtttctttggagaagctacgagcgaaactgacaaagacacctgaggcaactgatagtaatgctcctgcatctgaaagcactgtgactactaaagtcccagaggaacttgtacaagtccaggcttacataaggtgggagaaagcaggcaagccaaattatgccccagagaagcaattggtactactctaaattatcagctcaacaagcttttgctaaggtgactctttatgaagatttatattttgttttcgctaggtcgagtttgaggaagcaaggaaggaactgcagtctgagttggataaggggacctcagttgagcagttgaggaacaaaattttgaaagggaacattgagacaaaagtttccaagcagctgaaggacaaaaaatacttttctgtggaaagaattcagcggaaaaaacgagatattgtgcaactacttaaaaaacacaagcctactgttatggaagcgcaagtagagactcctaaacaacccactgttctggatctcttcacaaagtcattacaggagcaggataactgtgaggttctaagcagaaagcttttcaagttcggtgacaaggagatactggttaggattcttgactgacatttcatattcacaaaccttgcatccaccaatctaatctggcttaactgtttttaagggaattaccaccgttgctctaggaaaaaccaaagttcacttggcaacaaactatatggagccacttatacttcactgggcgttgtcaaaagagaatggagagtggcaggtaaaaacaaacatgtttgcaactcctaaagctatgaactcatcatctgaaatagacaatgtgggcctgtactgatggggtgctttgtaactgtgaaggcacctccctcaagcatattgccatctggttcatcattgctagacaaggcatgtgaaacttcattcagtgaatatgaattgaatggtctgcattgtcaggtatggataattttatcagcctattattttccattgtcttttacatttcctgtcatctaagtacttccccatttccaggttgttgagatcgagcttgacgatggtggatacaagcggatgccctttgttctccggtctggtgaaacatggatgaaaaataatggctctgacttttacttggatttcagcaccaaagttgcaaaaaatacaaaggcaattgcttctgtccactttttgcatagcaaccatgaaacttttttccctttgttttaaggataactttttttacgacatgttttaaggataaattcctcatatgccactgaatatttgctatatcccttattttccactcatttcctcactgatatgtgtcaattagcggcatgtaagagatgacttaggccttgttcggttatgcccggattcaatccggaccgggaatgacaagtataataagaaatttatatagatacaatgagagaccgggatttattccaggctgggaactaatttactcatgatatggacaataagagaccgggaatcaatccactagtcaagaggtgtagaactaatctgaatgttttgttgtccctatcatgagtaaattggttcccgatctggaataaatcccggtctcttattacatctatcataaatttgttactatacttctcattcccggcccggattgaatccagatgtaaccaaacaaggccttaaaaattttcaatgtcaaataagaatatctaaataattgtggtaaaaatcacttactaataaactgttgaatatattcgtaattaaaggatactggtgatgctggtaaaggcactgctaaggccttgcttgaaagaatagcagatctagaggaagatgcccaacgatctcttatgcacaggtcaggtgacacaatatctattacttgtatgacttgttctgtgtgttaaaaaaatccctgaactacctttattcctctacagattcaatattgcagcagatctagttgaccaagcaagagataatggattattgggtattattggaatttttgtttggattaggttcatggctacaaggcaactaatatggaacaagaactacaatgtgaagccacggtagatacttgtttcatattcttcagtgaattttctctctgtgcaaaaagaaatcaaattaactacataagtacttttttcttgtgatgggaataaaaaccttctagtcctaataaagcataacaggaaaaaaaatagaatgctgtttagcagactgaacctattctatttgcatatcacacaaacatgactttgttgcatcttctttaacatccataatgatctacaactatgcagtgagataagcaaagcacaagataggtttacagatgatcttgagaatatgtacagaacttacccacaatatcaggagatcttaagaatgataatgtctgctgttggtcggggaggtgaaggtgatgttggtcaacgcattcgtgatgagatattagtaatccaggtaaattaatgttcctaggtgaatatcaacttgtttgttgatcaacttgaactatacaacaataaatactagttggttggtattgtagagaaataatgactgcaaaggtggaatgatggaggagtggcaccagaaactgcacaacaatacaagcccagatgatgtagtgatctgccaggtaattgacatgcagatatttaatgccatacagatttcagcattggggttttgatatttatggacttgtgtctcttcatgggtaggccctacttgattatatcaagagtgattttgatattggtgtttactgggacaccttgaaaaaagatggtataacaaaagagcgtctattgagctatgatcgaccgattcattcagagccaaatttcaggagtgaacagaaagatggcttactccgtgacttgggcaattatatgagaagcctcaaggtatgtcaaacatctggcgtagataattgagatatctatgcagtatctttacgattttacgtaaatttttgcttttgcaaaggccttattttgctttgtagttaagaaatattacaagatctaccctaaacaatatactgctaatcacatatgctgaaaggtggcattctctggtaacagtacatgttattatgtcccatatgtgctgaataagggtcgaaagattaggataaaggctagattgctctcgttggtactgagcttgtcctgatattaagagactctggtcaagctaaacctaactttatgtttcttttttgcttaattgataatgtttcgctttggtccgttttagatggagggtaccctgatacaatcactgcgaatggtaacatgctccttaagagtaaaatctgcataattgacatctccagtgaaatcccatttctattattattttagggaattgcggcaggaatagaaatttatctctttgccttcatgtatgggaatcttaaggaaatgaaacaaaaatatcacactatagtttctacgtttcatatagtttaccaatcattctcttgaatcgtctccattatccagcacccctattactagcattgttaataaaaggcaagtgttaacatcaaactactccatccaaccaaatttaccaggcgtacacattccaagattcaaactttgtaagtttgaccaataattaggctaattatatatacatttagtgatataaaaaggtaccactagatttgtatttcattctaagattgcaagattcatttgtatgttttgaccaacaattaaatggtgccgctagatctgtattgcaagtatattgtcttggtcttctaattagaaaatttgtcattttcataattatactttgattcaatagtattgtacatttctacttctgttttcttaggcagtgcattctggtgctgatcttgaatctgctatagcaacttgcatgggatacaaatcagaggtaccattctcatgtctgttatactgtgaaagtttcatttggttatatatgatgtaattgtttctttgggatacagggtgaaggtttcatggttggtgttcagattaatccagtgaagggtttgccatctggatttcctgtaaaacatccttgccttcttttttttaaaaaaaacacatttatcataattaaaagctcataatattcattacttcaacagaaattgcttgaatttgtacttgaccatgttgaggataaatcagcagaaccacttcttgaggtgagcaatactaaacccaggcatgtttgcaatatttggtgccatgtccacgggtttacctccgttccattatctaaaaaaataaagaaaaacaaaattacaagacaatacttagatttcttataaatgactgatagctgacctgcctaatccatctggtctttgcaacttccatatgcatcctttgttgccaatgttgaaatgctaccttgcaggggttattggaggctcgagctgaactacaccctttgctccttggctctcctgaacgcatgaaggatcttatctttttagacattgctcttgattctactttcaggacagcagttgaaagatcatatgaggagctcaataatgtagaaccagaggttggttaacacaggatgttgctataggttacattatggcatgtgtttgtctcacattgtatcttgtctttttgacgattcaaatgtattaagtcatgttcctgttttatctaatccagaaaattatgtacttcatcagtcttgtccttgaaaatcttgctttatccaccgacgacaatgaagatatcctatattgcttaaaggtacaactgttctgtttttttccatgttatgtacacaattgtttagagaaatttaccttagttgttccattttcctaataaaagatacgaatagtggcagagcacaacataactatttatgtatatcagacagctgctgagaatatttgtcatattgctgttcatctgtgcttgttatccttttttccatgtagcaattagtttggctgttgtcctgagttttcttttttcctgaaataattaaaaaaaaagaatgaatcgactgtcttcagtatataactttgaccatcagttttggtttataattagaaacattttttaaaataatattatgaaagtcactgttaatgatactatggaagtatggatatggtaccgacgttcttgttttagatgttttactggaatgtatgcagtcatcagtttaattttctaatctctttttcgcacaaaattatttggatttgtcatgtggatgatactactagatttgccataaaaaacattaatgtcgttgtatgtttaataattttattaagttatacaatcaaacaaataattgttaaaggtgcttgttggtaatggtggctgtctgaaatgacaaagttaaaaggagctgaagttgtagcattttcatgtagccaatcttcgcattacaaagatgcctatggttgagtggcatataatgcaaaagtgtctttctttatggactggagtgattataactagttttttaaaagaaacttttttatttgaactatttgtgatttatgcattacaaacttttaaaatgcaaactaacctagtatgtgtcatgaagggatggaatcaagccttggaaatggctaaacagaaaaacaaccaatgggctctctatgctaaagcatttctggacagaaccagacttgcccttgcaagcaagggagaacaatactataatttgatgcagccctcagctgaatatcttggctcgttacttaacattgaccaatgggcagtaagtgcttaggaacttcagctatttttctatccagacacttaggaactagtcttaagtatcatttttggcaggttaatatctttacagaagaaattattcgtggtggatcagctgctaccctgtctgctcttctgaatcggattgatcctgttcttaggaatgttgcacagcttggaaggtaaactgcaaattcttgattatcattgtattctttaccttgtgcctgacatttattgcctaacagttggcaggttataagcccagttgaagtatcaggttacattgtagtggttgatgaattgcttgctgttcaaaacaaatcctatgataaaccaactatccttgtggcaaagagtgtcaagggagaggaagaaataccagatggagttgttggtgttattacacctgatatgccagatgttctctcccatgtatcagtccgagcaaggaattgcaaggttttcccagttcacagttatgtgcaatctttaataagattcgtcttttttattgatgtaacattgactatcttttctttttgaaggttttatttgcaacatgctttgatcctaacaccttgtctgaactccaaggacatgatgggaaagtgttttccttcaaacctacttctgcagatatcacctataggtaattcttgttattgttctgtgaattacatatatgatatatctgatgatgtgtgagctatgctacggatttcatcatgctagtaacttatttttttcagaggtttcttctatgagactagatcgtttttatttaataccttaagttccggttagggtgaggataattaaatctcttgggaactactggtagttgttttttgaaggacagtttcaataccataacaatggccagtaagatttggtttacagggttaataaaatcttcggttatatagggcctgtttgggtgagcttttagcttctgcagcttctcccagaatcagcagctcccctaaacagtctagcttttggtccagattctgagaagctgtagttgtagaatccagaaaatgaactagaagccagaagctggaaaacctagcttttccagattctcagaagctggctaccaaccaactacttctccgaatcttaagctcccccaaacaggcccatagataaccagcagcttaagtccctttactatcaccatgtggtgatttcagttagtcaagtcaaccagtttttaatagcttagttttttagtgtttttttcttgataatgcacagctttgcttaattgtccatcaaatgtttacattctagtatctaccatttgatagggagattccagagagtgaactgcaatcaggttctctaaatgcagaagctggccaggcagtgccatctgtgtcattagtcaagaagaagtttcttggaaaatatgcaatatcagcagaagaattctctgaggaaatggtaaataaaacaattatactccgttatattaatcgacttctttttgaattaagactttgccgcattagctgttgttattctttttcccattacctttgaccttgagctagcttcactattcattgtcaggttggggccaagtctcgcaacgtagcatacctcaaaggaaaagtaccctcatgggttggtgtccctacatcagttgcgattccatttgggacctttgagaaggttttgtctgatgaaatcaataaggttggcaatttttttgtgaacattaaatactgacaggagcttgtgattgtgtgatgagcctgtttattcttcaagatcaacatatacttacaaaaataaaaaacaaatgtacagtttgatattctcaaccaaagttctttttatgtttctatcaaacgacattttctgcattccacaggtctcttttgtatgcaaaacccagataagtttctagcaggcaattatttattgatcctttagtagcatcttcagaagccggtaggtctagctcattgcattacatcaactaaattagctggtttacaatgacacgttgaatatgtaatgatttttgagacagttgattgttttttctttattggcaggaagtcgcgcaaaccatacaaatgctgaagggaaaacttgctcaagatgattttagtgctctaggcgaaatacggaaaactgttctcaatttaactgctcctactcaactggtaagatattatagcgcaacataaagctgattaagtattctccatctccgcatatttcaatagaaaaaatagaacataaactcttgtttgcatttgttccaatcaaaaacctaaatctttactttgtttaaattttctgtttggaagaacaaggcttatttcttttgtttaccagatcaaggaactgaaggagaagatgctaggctctggaatgccctggcctggagatgaaggtgaccaacgttgggagcaagcatggatggcaattaaaaaggtctgctgtcctaccattcataccggagatagatccagacatatatctctcttatttctttcttttagctctttagaatacgttttaccagtttaaatactggaattggacttctttgcatataactttagcttctttgcatagagtacattttctcataatatattcatgggatcatttgacaccacaaatggcacctggatttgttatgggtagggagagttattaatcgtaaaatacgaatgttaaagaagccctttctaaaagtggtcatcagatatctaactttattgtatttaggtttgggcgtcaaaatggaatgaaagagcatattttagcactcgtaaggtgaagcttgatcatgactacctttccatggctgtacttgtacaagaaattgtcaatgcagactatgcctttgtcattcatactactaacccatcatcgggagattcgtctgagatatatgctgaagtggtgaaagggcttggagaaacacttgtaggagcctatcctggtcgcgccatgagctttgtatgtaagaaaaacgaccttgactctcccaaggtaaaagatttcttattaccacttgaaattgtatgttaaggtctacctgagctaaatgcattccatttgataggtactgggtttcccaagcaagccaattggtctcttcataaagagatcaatcatctttcgttcagattccaacggtgaggatttagaagggtatgctggagcaggactgtatgataggttagtgaaagtccatcataatttttgtagttcgctcaagaatttatttggcattacaactaagctgactgcttgtttcagtgtccctatggatgaggaagatgaagtcatactcgactacaccaccgaccccctcattacagatcagggattccaaaaatctatcctctcgagcattgcacgggctggtcatgccattgaggagctttatgggtccccacaggatgttgagggtgcagtgaaggaagggaagctatacgtagtacagacaagaccacagatgtaatctatatgtatattttatagccaagtcaatcaggcaatgttgtagagtaagatatacgggccgtgggacatgtataacacgttacgcccttttttttattatttgctttcatactcacaatacactaatttatagggcttattttatcgccaataagtgtaatctgactatgatcataaataagcctcctaggctactgaaaaccattaaaggttattttgatcaactggattttgcttctgcaatgataatgtaaatatcagtggtctgcttgcttttggtcctatccctttaaataaagccaagaagttgaaaagtatcagaaagttcttataaatatatgttctctgaaatggacagctacatggagatatctgaagcaaatatttgaagagagctatccccagtcgactgtaaccaaatactgaaagacacaaatggtgggattcttcagcctctgtacttccactcaatattatcgcatgcagctcaggaatggatcagttcagtatgaactgattagaccaattaagtacagaccaaagagcatcatcaggtgctgcagctctaaaggggaaaagccagggaggactactaccaagtgctgggagtgacggttaattcaacgcctcaggagatcaaggaggcttacaggaagctccagaaacgacaccatatcctgatattgctggctacaaggtgtgtcgtccatccgcatccgcatctacttcgattttggtgttgctagctacagggttcagtttttagtttcttggaagcccggatagaaatgttatacctttatcgatatcaagcttattttgttctttcttgtggagtttaaacgtgaaattcgcacttgaattttcagggtcatgcatgactacaccctactgctgaatgaggcatacaaggtattgatgaggaattaatagttcaaggaacggtgatgctagtggcagaggctttgggagaggtttcactggaaaagggtacagttgtttgtaatgggcctgtgagaagccatgcactctttgaggacgagaacaaatacataggtacgtagcatcaacatttctgatcatatatgaaggtctcccggtacatgccatcttataaggtggacctttatgattttctaaagaattaatttttgaatgggctaagacccaaccattaattccaacactaattagtgcagaagatacaggtaccaatagttgttcgagtttctaacgaagcatacactgtcattcaaactgtttgaggcactatttatcagggtaccaatgtactaaaattatttaaatttttgaacaaaatttgaacaaaatattgccaaatttacaaaaaaaattgaaaaaaataaaaatttcggatgtaataatatcatatcggggtctgatagaaccaaaatgtcgtaaatttcatcccggaattttgaaccctgctatttattagttccatatccattgctccattggagattttttataccaatatttttttatctaaacacatgcattcatctaattcgagatgtatgcatgcaaatccagcatttaaatttgtaggcatattcttacatgtgtactgattgttccatcacatcaaactgttcgtccaacaaactactaaatccctggtgaattgtcctttcttgctcatctctctactaatgcagcaaacaattttgcttgagttcagatggtgtttttttttattttggaaattggaactgtatcggacatttagttaaatagacaacctagttattttgttgggcatcaggccatcagctcaaccagattgacatggtcacttgtgcatgttgcttagaaacagaatttattaagggagccgcatgtgtttacatgacaaaattttggtta

SEQ ID NO: 174 - DNA, 5287 bp, Oryza sativa
  misc_feature (1)..(5287): DSP gene Os03g01750
acccacctcacctcacatcctcttcctctcgtctcgcccccggcccccttcttctctcctcttcgcggcgactgcgaaagccatctagtatctccttccttccttctcgactcgcctacgccaacgccaacgcgagatatttttgggctcctcggcctcggcgtcctcgctcgccgtcgcgcccgcgcgggcagggcacgggagggaagccatgaactgcctccagaacctgctcaagtaagtgagtgcggtggccgaggccccggcgcctcctcctcctccccgcttcgattcgattcgacacttgtttcgcctgttcgtcactgctggatttcctcgttttcgcccagggagcctccaatcgtgggatccaggtccatgaggcggccctcgccgctcaatctggtgacccctcttccattccattccattcacgtccttgttttttcccctattattgatggatcggctcccttatttgttcctctttttgatgtccatgatgactagacgatggttcgtggcgggagtcgccgatcaaacactgtcaaaaccgtaagcattcccttcacctgcatatgaattgatctacccgagattagaggcagttaactcgtcaaatccccgacaataataattatcatatgatagaatccgctgcagtgcagcctgcatgtttcaccccattgtgtaaaccttgtcctgtaaacattccaggcatccggggcgtctacttctagcgccgagagtggcgcagtggaggcgggcacggagaaatccgatacgtacagcaccaacatgacgcaagctatgggagcaggtaaagacccattatgccttacctgcaatcaatactacatgttagctgtaccacgacttgtcggattgtactcgacctgctgctcgctgactttaatggttccttacccagatgataaatggggaaatgcactaacatcatgtagatgtcaccatcaaagtgttgtgccaccggtgtgtttttgtgtctgtcggtgcaaactcacatgcttgttttacttactccctccgtttcacaatataagtcattctagcatttcctacattcatattgatggtaatgaatctagacatatatacctatctagattcattaccatcaatatgaatgtgagaaatgttataatgacttacattgtgaaatggaggaagtagcatttatgtgtcatttttctccattcctcatgaacaagtcacgacgcattcacaattttttttcttactcttaccttccccttcttccaacaattgaccttgcagagggtgcattagtcatgtgtacaaacattgttctgccactgatttttatcttaaaagtattcttgcttgtccattgtcttaagattttcatacaactttatagtttacaccgaacagttgaaatattatttctttgaggacaatggttgtgaccatatttatggacaggcttgtactattcactaagcttttactggattactgtctatcattgatcactcctgagatcatttcctttttttctaaatcatttctagtgttgacgtatagacatgagcttggaatgaactacaatttcatacgcccagacttgatcgtgggctcctgcttacaggttctcaaatatcatctatctcaaccaatttacagaaggaaaaaaaaacacttcttaactctgtctgattagctgcattcatgtgcagagcccacttgatgttgataaacttagggacattggtgtaaaaacagtattctgcctgcagcaagatccagaccttgagtatccctattattgatttttttttctcatcatgcttataaaaagaaaggagcatgccaattatgttgcctggtttagagaatttgagcctcttgattcttgaaatgtatgctgtcacttactgtgaatcacaccaactatatcgaagagaattataaaattctggtgatggctttttatcaaaataactattggaatagggagtgcttttatgtcagcatgccttcttcctaattatgttactgtgctattggacaataaccataattctattgaacaattacatttgctcctcacttccctgctactgtacttcttctgcagctatgatattcagcacaatgcatattgtacatctcataaaaatagttctattttatactgacagcatagttgcttgttgtttccattgctgcccaatgtgttctttcagtgaatagttgtattccatccttaaccagttcagatattttggagttgacatctgtgccattcaagaatattgtctacaatgtaaagatatagagcactgtcgtgccgaaattaggtacctaaagttctataacttcgttttactttgagaaactaagaattttggtgatttggtgtagtctatgtcaaatgcaatagaaatccctttattttcattaataatgtctacaagatggcatgatctgaacgtctatctcttttcccccttctctttccaattataattcctatgctcttctatttttggaatagatgattcatctttccttgaatcagcatttatttgtcaaatgtaacttttcctgcattgacttgaatgccttttccattgtctgttctgtccatattttcaaagtcttaaagtggcataatgtttaattacaccagggattttgatgcttttgatttgcgattgaggcttcctgctgtgattagcaaactgcacaagcttgtcaaccataatggtggggtaacatatatacactgtaccgctggacttgggagagctcctgctgtgacagtaggtttccatggtcttttcttttttgtttcccaagaattcttataataggtttaggtttacattataatattgtcttcttctttcctgttcagttagttgttggcccacccacaaaaagggaagaaaaatggaaaacacatatatacattcccaaataatgaacattaactagtgtctagtgagtcctagactataacataatcatcacaggtatagtcggtaaattgttctatttgcacaatgttatagtacttaaataatccaatagtatcacaactgactttcactctcatgatattgctgatgcctgtccaagtttcacgctggattgatgattatagtatcaggatcctctatgatttgatggtgtccattatcttgagagcagcaatattctgatcctgataccattatataaattttcagttggcgtatatgttctggattcttggctacagtcttaatgaagggcatcagctactacaggtatcttatactgtttagaacagtacaaaacaatgtgtgtgggaaaataattttgtttttataatttgtgtgcactggtaataccaatggataccaacaggttgcctgtgtgtacatctctcacaactatcttacaaagtaaagtctgttggtggtctggtgtcctgttaccacattgctactagttatgttactatgctacttgcttcccctgaacatatgtttcttctgcagagtaaacgagcttgctttccaaagttggaagccattaaattggctactgctgacattgtaagtgaacactcaccaatatttctttttttttccctcagtgtgtagttatgatggttaagataaaaggcactgcttgtacaattttgtgctaagtgatgactctcttaatgtttagctgacaggcttatcaaagaattccatcactttgaagtgggaaagtgatagttgttcttctgttgaaatttctgggcttgatgtcgggtggggacaggtatgcttttgtgccaactatggtagatatattaatgtcgaaaactcatccactcggtggagttttttttaaagaacttttttaagtttactttccagtgtaatagaagctaactgtggtgttagcaccttttttttttttgcagaaggcattcttaattgatttcctgtttatgatttgcatttgttctgcttactcagataattcctttgacatacaacaaggagaaaagagcttggtatcttgagagggagttgcctgtgagtatcaaaatcagcattatattatcaatttctagactttattttttatcactcatcattctagtgcttgtatagtagatgccggatgccaccaacgtgtaacttctagttggatcatctaaaagtctttacgtttgaggaatacttgaggatttgaaccgagggttctgaaagactgtaactagagaaccttagtttgaaccgtatttgggatatcctaatctcatatgttgacactggaggcaatcgttttggtcctttccctttacagttattgatttgccatatctgttacacagttggactcgattttacagtagctaacttcacactcacttttccttatacatttgccttgtgtttcccgaaggaaggaaggtatgaatacaaatatatagtggacggcaaatgggtgtgcaatgacaatgagaagaagaccaaagcaaatgctgatggccatgtgaataactacgtccaggtgagttacttcccagctccctagttccctgtatctgtggacgtgttggataggataacgtaacttgacgtcttcattgcaggtctccagggatggtaccagcgatgaagagagagaattaagggagcgtttgactggtcaaaatcccgatcttacgaaggaggaaaggctgatgattagagagtacttggaacagtacgttgagcgatagaggtaagttgaaatttattcagactactagtattgtgttgcaggggttttgctgattatgcttatgcatgaacatatcattcggattggactgcactaatctgcagaattgacattggattatcgactcgttttgggctcgctgtgcaacagggaagacctgctgatgatcaacaacagatcatggagcttcccgatgaacagagtagacggagcttccaaatgttatcatcttgggtcgccatgtcaatactattaattaattagttcaaatcaaccctgtaaatggtttactcatgagtaatcacgagtcgtcgctgtaaacaaacgatgcataagacgagcaatatgcgtttgctcatagtaacactgtggccgtataacaaggtagaattaataaggctgttagactgtaataagggctgttaattaacataacaggttacaaagttgtgtaacatatatgttattaatgctgactcgtgaatggaagacaaattaattttgtttgggacagttgctcccgaagtga

SEQ ID NO: 175 - DNA, 7001 bp, Oryza sativa
  misc_feature (1)..(7001): ISA3 gene Os09g29404
cttaaaggatgtaatatatctcagttttacctatggacatccaaataccaaattattaattatattttctgttaagcctttatttatacagctttacagctggttacttttaagaaaaatgctatgatttatttctgaaattactgcttgtgtatcttgctgatctaacatgtttaatgactagatacttacatatcacatgatttgttcaaaattttgaaagtgtaattgtttcacttttaagtcttaacggtatgttttggttcaacctagggaatacactgaactgcaaccatcctgttgtcaaggagctcattcttgacagcttgagacactggtatggacaacttgcagctaagatttttctcataaatccaattgtgtgtagattcatccatatttctttgtttcatcttgactatgtcggcattattcataatcaagtgtcaaaaaatatctatatcgatttgagctttcatgttggtatgatcagaccaagatgatgtatcgacagcctaaaattattcaaaatttcctctaggctatagcacatgcttgtagctatttggcttgtagcaagacagttgatatatgagagatagttcatggctatgtcttattgtgaaccttggaaaacaagatagccagaaactgcaacaaaaacagttatttttatacaaataactgaattatagcatgcatttttattttctctttgacaatggttttgtcatatttcaaatgtcatttctaatctccatgcttgttttaatgcatcaagggttgaggagtatcacatagatggatttcgatttgaccttgcaagtgttctttgtcgtggaccagatggttgtcctcttgatgcacctccactcatcaaggtataatgtagatgcagactttaggtttgaacactaaatatgtatggctgcttaccaagcctgtgcagaccgaattttgtttgtctaaataagtgaatttaatagatttcatgtaaaaacaacccgtacgttacattatatggatgattggatgcaaattatgatgtactgaagtactgaacttccagcaatcaattctaatcaactttgcactattgttgattgttttcttgtttgcatggttttgttcattgaatacatatctagtgcaagctcacaggaatgcaatcatgaaaatttgcaatgtgggcagctatataagatacagtatggactagatgtagggctcttgaggttcatttgaaagtttttttagtgacccccctcaaacgttagaaaattgtatttatgacaaattccaccttttcaagaccatctaaatcctaatccatcaatctctggtcatacaactcacgttgatgtatcgagactagtggcttttatgtttcttcatattaatttatttggttgtaggaaattgccaaagatgctgtattatctagatgtaagatcattgctgaaccttgggattgcggcggcctttatctcgtagggcgtttccctaactgggacaggtgatttgaacacttctatatttctataaaaagaatttggtggtatagatgttttatccttgcttcttttaggactaaagatttggtgatacagtaacacaaaacagtaactattttctgttatggataatatcatgctgagatgctcattcctaaagtacttaacaactgaattcttgaaatgagagaattattgctagtatcacttttctcattggacttggcaaacatgcttcattgtgcggttcagtgacctttccctaccatgcatacacagatcagttattctataatgagtttcatttatttttaaaggtatggtgatcatgtttaacattcctcttgcaggtgggctgaatggaacggcaaatacagagatgatcttcgaagatttattaaggtaatatgccgggagagaagattttttagaaaatacagataagaaaaattgtactcacctgcaatttatggtagagatttcatcatggcagtatatcaggaattactgctgaggaataggattgttatgcccttatgctaatctatcattcccttgcctcatccctttctgccagagtattttaattaaccatgccataggatagttattttactgagcatgttaatgaagtttagcttctcactgtacctatatttagttttaattgtccttgatggtgtatgaacattagcggcaaacttaggttattgtggaacagccaatggctaggaaacatggagattttgttaaatgtttaactagatataggatcagtacccttgcaaaatcagtattttatttaatttaatgggcaattctgaagcatacgatcacagttccgcatattatttgagaaaatggcaacatacttttatgcaatagctctgtaccagttgtgtaaagattaccaggttactgaaacataggggtagaattaggtggctgcagtttcccaaactctgatcttggctatccataactccattcttgagccaaatatttagatgatctccttcagaacttgagcataattttttttaaccatttcaaacatcagtgagttttttcaactgaagatctgaatttactgaacattctgcattttatcagtgcttgcctagcatagccatgagaattcttctgtttgtgttcttttattcttgtttctataataacgaccgaatgactgattggatgctgctaaacatttggagttgtttctcagggtgaccctggtatgaagggggtgtttgcgactcgtgtgtctggatctgctgatctctatcaggtccccctcttttagatgttattttccctttactgttattttttatccatttgcttaggatatcgcttgtttttgaactttgatccccccccacacacacaaaataaataaaataaaaatccatttccaaacaagagcggcttccaaagttattgctaataagtttaggtttaattacatgcttgttacttttgtatcactgttagagcataggtcattatcaacatttagcgtgccccaaattctatcatgtcaattgtgttagttcagtaggatttctccagtatccaattgtttaatggatataaatgtattcagggtctagtgacataccatttgatagtgcaaaacacagtatggtatgatgccacctattatttcattttgtgaggatgtgtaaggaacctctgtggacaaatttttaagaactactgttacactgaaggggttcagactcagttattttttgtcaagaaacaaaaatatgtaaaataaaattcacctgatgtggcaggtgaacgagcggaagccttaccatggtgtaaattttgtgattgcacatgatggatttactttatgtgaccttgtttcttacaacttaaaggtaactggagtaagctaagcagtttagttaagatcatttatttatactgtgaagtgtatgctaatctgccttctttttatcaaaatcatatagcacaatgatgctaatggagaaggtggctgtgatggatgcaatgacaactttagctggaactgtggtgttgaaggtacctgctttaccgaatatctattttcttttgtacattgaaatcatgattccatgaaactgcaaaaagatgcttattttcatatcccatcaaattgatacatctgactgatgtagggtactgtaaagatagaaaacttggtcgagtttattattaaaacaaccctttgtatgaattaaaggtatagtcataaagagaatgacatagtttgattttgttgaaatttagtgtcttgtattgattttgttgaaatttaatgtcttgtaattcaacagaactaaaagattgcccctagtagtgaagcttcaatgtcaagatggatccaaatagctctatgagctgtgcagaactttccaaatgcaaccatagatggctatccctctttgaatcagaaataattatttttagggttaattggatccatgccactgcaaatgtggcaaatcaaaaaaatgccacacatatttgcgttatcggctggatgccactgcaaatttttaaaataagaaccatgccactccatcacgatttccgtccaatccgtcacattttccgccgtctccgtcttcgtcctctcgtcgtcctcgtctcgacggcagcaccagcacggcagtacgaaggcgggcgcggatggcagcacggcgcacggcggcacggcagcacggtggtggatggcagcacggcaccggcgacggtcgtgcccgcgtccgctccccgcgcccctccgcgacctcctcgccgacttcctctctctccaccgttgcagccgtcgtcgttgaccatttccgcggtggacccgccgccgttgacctcatctgcgcgggagagctcgggagccgccgccgccgttgctgtcctcgtcgtggtcgtcgacgagccgcaccgcctccgcccagatctggcgaggagggccgctcgtcgttgctgccgatggaggaggcgtcgagcctcgaactccgccgctgttggccccaagctttgtcactagtgctgccgacgcccatctcctctctccacatgaccatcctcggcagcagctgcgccccctccgcgacctccccgcgaagcgtcctcgtcggcggcggcggcctcgctcgcgaccgtcctcgccggtagtggctatgcccgcgtccgcctccacggccgtcctcggcagcagctatgccccctccccgacctccccgcgagcgtcctcgctggcggcggctacgcccgcgcccgcctccgtgaccttcctcggcggcggccatgcccctccgcgaccgtgctcgtcggcggcggcaaagatcgatggttgtatgttgattggtttagttagctagctagctagcctcgcgcgctgcatctgtagcagctagctagctactccctgagcttgttgggtgtttctgcctgagctccattccgcgccgaaccccgtcaggcccggccgcgaccgcgccgggctgtcctccgcccgtgccagccgtcgcgccagctccccatcctcttctccgttttgccgcgtgaagccgatgcgttttgtcgcgtgcgcctcatcggcttcgactccggtggttgagctgctcacacgcgtccgggggcagcagaagtgagagagagagagaggaggacggaaatcgtgatggagtggcatggttcttattttaaaaatttgcagtggcatccagccgataacgcgaatatgtgtggcatttttttgatttgccacatttgcagtggcatggatccaattaacccttatttttaacctaatgctatgcgaaatgtttgatgttagaattgatgctcttgttctgtaacaggagaaacaaatgatctgaatgtgttaagtctgcgttcaagacaaatgaaaaacttccatgtagctttaatgatttctcaggtaaacattgtgaagtaacctacagtttattttatgtgtgcatcatgtataaacttatcacataatcaccattttcatatatcagggcaccccaatgatgttgatgggcgatgaatatggtcatacacgttatgggaacaacaatagctatggacatgatacttgcattaataatttccaatgggaacaggttgcattaccgtaactattttagttttcaaccaggaatatgtttatgaatttggcagatctatatataatttgttttctccgaatccatgtgaatatagttggaacaaagaagagatggccatttcaggtttttctcagagatgataaagtttcgtcacagcaacccaatattaagacgagacaggtttcttaataaagtaagtaatacctagaagtgctatcattgcaattaactggtttattgaagacaatcatttcatcatcttctcaaaaaatagctgctggtgtctgtcgaaattccaagtatattttctcagtcaagtctgattagaatagtataatacagcaaatatacactttgcagcttttgcagttgcatctcttagtttttttttcgtctcaaatgttcttcattgtattgtgatcttccttgttggtagaacgatgtcacctggcacgaggattgttgggagaaccaggaaagcaaatttttggcattcacgtaagtttgttgatcactttcgtttatgcaccttattatggtatttgtttatgatgctccaaaatccaaattcttggcttctgactttcattgccattttactgtagagtacatgatcacaactctggtggagatatctatttggcattcaatgcacatgactattttgtggacgctgtaattcccccaccaccacaccataaatgttggaaccgtgtggtatggatacttttcagcattgctaaatttcttacgtatagtaaagtaaattcctacataatcctagcatggtgtggttgtaatttctaaatatgtagaagtgctgccagtactcattctgaattttactacattagacgctcggacaaataccaactcttaaaagaagatatacaagtttccacaaaatttctcaggaatagacataggtagtactgatacagttctacaaccaaaagctgtatacggttgttacttgtgctagcaatcctgctaaaactggtttggagtttattgctcattagctacttttaatttttacaatgattggtctggctggatttgatcactcttttctcacacctttccgctcctattgtcattctaaatctgctctaataatctttttgtaggtggataccaacctggaatcaccaaatgatattgtaccagaaggggtgccatttacaggaccaaaatacagaattgctccatactcttccattctgctcaaggcaaagccttagaaaagttagtagttgagagcataaaaataatgccaccaatgctggcttggttggttaataacaggttgatcacattagcagtctgcacttcaaaaaggcaa

SEQ ID NO: 176 - DNA, 4518 bp, Oryza sativa
  misc_feature (1)..(4518): GWD coding sequence -1
ggaaggcccagccggcccatgagcggattctccgcggcagctgctgcggccgagcggtgcgcgctcggcctcggcgtccacgcgcgccccgcctcgccctcgccggcgctgctcccgccggcggctctccgccgcggccgccgcctcatggcgctaaggaaggagagatatccatccggatcccggaagccgaatccatccatccatccatcccatactgcccttacgatcgagctgtttgatattcgtgcagatgagcggattctccgcggcagctgctgcggccgagcgcttgtcggaaggttcaccctggatgccaactccgagcttaaggtgacattgaacccagcaccgcagggttcggtggtggagatcaatctagaggcaactaacaccagcggctccctgatactgcattggggcgcccttcgcccggatagaggagaatggctcctaccatcccggaaaccagatggcacgacagtgtacaagaacagggctcttaggacgccttttataaagtcaggtgataactccacgctgaaaattgagatagatgatcctgcagtgcaagccattgagttcctcatatttgatgaggcacggaataattggtcagttctttttgggttacccatcctaccctgtttcttggaatgcagaagatatcaaataacaacactctactttggacaggaggagtatgaagcagcacgaactgagttgatagaggaattaaacaagggtgtttctttggagaagctacgagcgaaactgacaaagacacctgaggcaactgatagtaatgctcctgcatctgaaagcactgtgactactaaagtcccagaggaacttgtacaagtccaggcttacataaggtgggagaaagcaggcaagccaaattatgccccagagaagcaattggtcgagtttgaggaagcaaggaaggaactgcagtctgagttggataaggggacctcagttgagcagttgaggaacaaaattttgaaagggaacattgagacaaaagtttccaagcagctgaaggacaaaaaatacttttctgtggaaagaattcagcggaaaaaacgagatattgtgcaactacttaaaaaacacaagcctactgttatggaagcgcaagtagagactcctaaacaacccactgttctggatctcttcacaaagtcattacaggagcaggataactgtgaggttctaagcagaaagcttttcaagttcggtgacaaggagatactggaaaaaccaaagttcacttggcaacaaactatatggagccacttatacttcactgggcgttgtcaaaagagaatggagagtggcagacaatgtgggcctgtactgatggggtgctttgtaactgtgaaggcacctccctcaagcatattgccatctggttcatcattgctagacaaggcatgtgaaacttcattcagtgaatatgaattgaatggtctgcattgtcaggatactggtgatgctggtaaaggcactgctaaggccttgcttgaaagaatagcagatctagaggaagatgcccaacgatctcttatgcacagattcaatattgcagcagatctagttgaccaagcaagagataatggattattgggtattattggaatttttgtttggattaggttcatggctacaaggcaactaatatggaacaagaactacaatgtgaagccacgtgagataagcaaagcacaagataggtttacagatgatcttgagaatatgtacagaacttacccacaatatcaggagatcttaagaatgataatgtctgctgttggtcggggaggtgaaggtgatgttggtcaacgcattcgtgatgagatattagtaatccagagaaataatgactgcaaaggtggaatgatggaggagtggcaccagaaactgcacaacaatacaagcccagatgatgtagtgatctgccaggccctacttgattatatcaagagtgattttgatattggtgtttactgggacaccttgaaaaaagatggtataacaaaagagcgtctattgagctatgatcgaccgattcattcagagccaaatttcaggagtgaacagaaagatggcttactccgtgacttgggcaattatatgagaagcctcaagatggagggtaccctgatacaatcactgcgaatggcagtgcattctggtgctgatcttgaatctgctatagcaacttgcatgggatacaaatcagagggtgaaggtttcatggttggtgttcagattaatccagtgaagggtttgccatctggatttcctaaattgcttgaatttgtacttgaccatgttgaggataaatcagcagaaccacttcttgaggggttattggaggctcgagctgaactacaccctttgctccttggctctcctgaacgcatgaaggatcttatctttttagacattgctcttgattctactttcaggacagcagttgaaagatcatatgaggagctcaataatgtagaaccagagaaaattatgtacttcatcagtcttgtccttgaaaatcttgctttatccaccgacgacaatgaagatatcctatattgcttaaagggatggaatcaagccttggaaatggctaaacagaaaaacaaccaatgggctctctatgctaaagcatttctggacagaaccagacttgcccttgcaagcaagggagaacaatactataatttgatgcagccctcagctgaatatcttggctcgttacttaacattgaccaatgggcagttaatatctttacagaagaaattattcgtggtggatcagctgctaccctgtctgctcttctgaatcggattgatcctgttcttaggaatgttgcacagcttggaagttggcaggttataagcccagttgaagtatcaggttacattgtagtggttgatgaattgcttgctgttcaaaacaaatcctatgataaaccaactatccttgtggcaaagagtgtcaagggagaggaagaaataccagatggagttgttggtgttattacacctgatatgccagatgttctctcccatgtatcagtccgagcaaggaattgcaaggttttatttgcaacatgctttgatcctaacaccttgtctgaactccaaggacatgatgggaaagtgttttccttcaaacctacttctgcagatatcacctatagggagattccagagagtgaactgcaatcaggttctctaaatgcagaagctggccaggcagtgccatctgtgtcattagtcaagaagaagtttcttggaaaatatgcaatatcagcagaagaattctctgaggaaatggttggggccaagtctcgcaacgtagcatacctcaaaggaaaagtaccctcatgggttggtgtccctacatcagttgcgattccatttgggacctttgagaaggttttgtctgatgaaatcaataaggaagtcgcgcaaaccatacaaatgctgaagggaaaacttgctcaagatgattttagtgctctaggcgaaatacggaaaactgttctcaatttaactgctcctactcaactgatcaaggaactgaaggagaagatgctaggctctggaatgccctggcctggagatgaaggtgaccaacgttgggagcaagcatggatggcaattaaaaaggtttgggcgtcaaaatggaatgaaagagcatattttagcactcgtaaggtgaagcttgatcatgactacctttccatggctgtacttgtacaagaaattgtcaatgcagactatgcctttgtcattcatactactaacccatcatcgggagattcgtctgagatatatgctgaagtggtgaaagggcttggagaaacacttgtaggagcctatcctggtcgcgccatgagctttgtatgtaagaaaaacgaccttgactctcccaaggtactgggtttcccaagcaagccaattggtctcttcataaagagatcaatcatctttcgttcagattccaacggtgaggatttagaagggtatgctggagcaggactgtatgatagttcgctcaagaatttatttggcattacaactaagctgactgcttgtttcagtgtccctatggatgaggaagatgaagtcatactcgactacaccaccgaccccctcattacagatcagggattccaaaaatctatcctctcgagcattgcacgggctggtcatgccattgaggagctttatgggtccccacaggatgttgagggtgcagtgaaggaagggaagctatacgtagtacagacaagaccacagatgggaaaagccagggaggactactaccaagtgctgggagtgacggttaattcaacgcctcaggagatcaaggaggcttacaggaagctccagaaacgacaccatatcctgatattgctggctacaagggtcatgcatgactacaccctactgctgaatgaggcatacaaggtattgatgaggaattaagcggccgcaacc

SEQ ID NO: 177 - DNA, 1137 bp, Oryza sativa
  misc_feature (1)..(1137): DSP coding sequence -1
ggaaggcccagccggcccatgaactgcctccagaacctgctcaaggagcctccaatcgtgggatccaggtccatgaggcggccctcgccgctcaatctgacgatggttcgtggcgggagtcgccgatcaaacactgtcaaaaccgcatccggggcgtctacttctagcgccgagagtggcgcagtggaggcgggcacggagaaatccgatacgtacagcaccaacatgacgcaagctatgggagcagtgttgacgtatagacatgagcttggaatgaactacaatttcatacgcccagacttgatcgtgggctcctgcttacagagcccacttgatgttgataaacttagggacattggtgtaaaaacagtattctgcctgcagcaagatccagaccttgaatattttggagttgacatctgtgccattcaagaatattgtctacaatgtaaagatatagagcactgtcgtgccgaaattagggattttgatgcttttgatttgcgattgaggcttcctgctgtgattagcaaactgcacaagcttgtcaaccataatggtggggtaacatatatacactgtaccgctggacttgggagagctcctgctgtgacattggcgtatatgttctggattcttggctacagtcttaatgaagggcatcagctactacagagtaaacgagcttgctttccaaagttggaagccattaaattggctactgctgacattctgacaggcttatcaaagaattccatcactttgaagtgggaaagtgatagttgttcttctgttgaaatttctgggcttgatgtcgggtggggacagataattcctttgacatacaacaaggagaaaagagcttggtatcttgagagggagttgcctgaaggaaggtatgaatacaaatatatagtggacggcaaatgggtgtgcaatgacaatgagaagaagaccaaagcaaatgctgatggccatgtgaataactacgtccaggtctccagggatggtaccagcgatgaagagagagaattaagggagcgtttgactggtcaaaatcccgatcttacgaaggaggaaaggctgatgattagagagtacttggaacagtacgttgagcgataggcggccgcaacc

SEQ ID NO: 178 - DNA, 1131 bp, Oryza sativa
  misc_feature (1)..(1131): ISA3 coding sequence
atgttttggttcaacctagggaatacactgaactgcaaccatcctgttgtcaaggagctcattcttgacagcttgagacactgggttgaggagtatcacatagatggatttcgatttgaccttgcaagtgttctttgtcgtggaccagatggttgtcctcttgatgcacctccactcatcaaggaaattgccaaagatgctgtattatctagatgtaagatcattgctgaaccttgggattgcggcggcctttatctcgtagggcgtttccctaactgggacaggtgggctgaatggaacggcaaatacagagatgatcttcgaagatttattaagggtgaccctggtatgaagggggtgtttgcgactcgtgtgtctggatctgctgatctctatcaggtgaacgagcggaagccttaccatggtgtaaattttgtgattgcacatgatggatttactttatgtgaccttgtttcttacaacttaaagcacaatgatgctaatggagaaggtggctgtgatggatgcaatgacaactttagctggaactgtggtgttgaaggagaaacaaatgatctgaatgtgttaagtctgcgttcaagacaaatgaaaaacttccatgtagctttaatgatttctcagggcaccccaatgatgttgatgggcgatgaatatggtcatacacgttatgggaacaacaatagctatggacatgatacttgcattaataatttccaatgggaacagttggaacaaagaagagatggccatttcaggtttttctcagagatgataaagtttcgtcacagcaacccaatattaagacgagacaggtttcttaataaaaacgatgtcacctggcacgaggattgttgggagaaccaggaaagcaaatttttggcattcacagtacatgatcacaactctggtggagatatctatttggcattcaatgcacatgactattttgtggacgctgtaattcccccaccaccacaccataaatgttggaaccgtgtggtggataccaacctggaatcaccaaatgatattgtaccagaaggggtgccatttacaggaccaaaatacagaattgctccatactcttccattctgctcaaggcaaagcct

SEQ ID NO: 179 - DNA, 313 bp, Artificial sequence
  Synthetic construct, GWD1 driver sequence
tagcgctaaggaagggagagatatccatccggatcccggaagccgaatccatccatccatccatcccatactgcccttacgatcgagctgtttgatattcgtgcagatgagcggattctccgcggcagctgctgcggccgagcgcttgtcggaaggttcaccctggatgccaactccgagcttaaggtgacattgaacccagcaccgcagggttcggtggtggagatcaatctagaggcaactaacaccagcggctccctgatactgcattggggcgcccttcgcccggatagaggagaatggctcctaccat

SEQ ID NO: 180 - DNA, 575 bp, Artificial sequence
  Synthetic construct, GWD2 driver sequence
agcagatctagttgaccaagcaagagataatggattattgggtattattggaatttttgtttggattaggttcatggctacaaggcaactaatatggaacaagaactacaatgtgaagccacgtgagataagcaaagcacaagataggtttacagatgatcttgagaatatgtacagaacttacccacaatatcaggagatcttaagaatgataatgtctgctgttggtcggggaggtgaaggtgatgttggtcaacgcattcgtgatgagatattagtaatccagagaaataatgactgcaaaggtggaatgatggaggagtggcaccagaaactgcacaacaatacaagcccagatgatgtagtgatctgccaggccctacttgattatatcaagagtgattttgatattggtgtttactgggacaccttgaaaaaagatggtataacaaaagagcgtctattgagctatgatcgaccgattcattcagagccaaatttcaggagtgaacagaaagatggcttactccgtgacttgggcaattatatgagaagcctcaagatggagggtaccc

SEQ ID NO: 181 - DNA, 506 bp, Oryza sativa
  misc_feature (1)..(506): Portion of GWD2 in Fig. 4
tggaatttttgtttggattaggttcatggctacaaggcaactaatatggaacaagaactacaatgtgaagccacgtgagataagcaaagcacaagataggtttacagatgatcttgagaatatgtacagaacttacccacaatatcaggagatcttaagaatgataatgtctgctgttggtcggggaggtgaaggtgatgttggtcaacgcattcgtgatgagatattagtaatccagagaaataatgactgcaaaggtggaatgatggaggagtggcaccagaaactgcacaacaatacaagcccagatgatgtagtgatctgccaggccctacttgattatatcaagagtgattttgatattggtgtttactgggacaccttgaaaaaagatggtataacaaaagagcgtctattgagctatgatcgaccgattcattcagagccaaatttcaggagtgaacagaaagatggcttactccgtgacttgggcaattatatgagaa

SEQ ID NO: 182 - DNA, 506 bp, Oryza sativa
  misc_feature (1)..(506): Portion of S. lyco. GWD gene in Fig. 4
tggaattcttgtatggatgaggttcatggctacaaggcagctgatatggaacaaaaactataacgtgaaaccacgtgaaataagcaaggctcaggacagacttacagacttgctgcagaatgctttcaccagtcatcctcagtaccgtgaaactttgcggatgattatgtcaactgttggacgtggaggtgaaggggatgtaggacagcgaattagggacgaaattttggtcatccagaggaaaaatgactgcaagggtggtatgatggaagaatggcatcagaaattgcataataacactagtcctgatgatgttgtgatctgtcaggcactgattgactacatcaagagtgattttgatattggtgtttattggaaaaccctgaatgagaacggaattacaaaagagcgtcttttgagttatgaccgtgctatccattctgaaccaaattttagaggagatcaaaaggatggtcttttgcgtgatttaggtcactatatgagaa

SEQ ID NO: 183 - DNA, 380 bp, Oryza sativa
  misc_feature (1)..(380): DSP1 driver sequence
ctccaatcgtgggatccaggtccatgaggcggccctcgccgctcaatctgacgatggttcgtggcgggagtcgccgatcaaacactgtcaaaaccgcatccggggcgtctacttctagcgccgagagtggcgcagtggaggcgggcacggagaaatccgatacgtacagcaccaacatgacgcaagctatgggagcagtgttgacgtatagacatgagcttggaatgaactacaatttcatacgcccagacttgatcgtgggctcctgcttacagagcccacttgatgttgataaacttagggacattggtgtaaaaacagtattctgcctgcagcaagatccagaccttgaatattttggagttgacatctgtgccatt

SEQ ID NO: 184 - DNA, 512 bp, Oryza sativa
  misc_feature (1)..(512): ISA3 driver sequence
ctagcgaatacactgaactgcaaccatcctgttgtcaaggagctcattcttgacagcttgagacactgggttgaggagtatcacatagatggatttcgatttgaccttgcaagtgttctttgtcgtggaccagatggttgtcctcttgatgcacctccactcatcaaggaaattgccaaagatgctgtattatctagatgtaagatcattgctgaaccttgggattgcggcggcctttatctcgtagggcgtttccctaactgggacaggtgggctgaatggaacggcaaatacagagatgatcttcgaagatttattaagggtgaccctggtatgaagggggtgtttgcgactcgtgtgtctggatctgctgatctctatcaggtgaacgagcggaagccttaccatggtgtaaattttgtgattgcacatgatggatttactttatgtgaccttgtttcttacaacttaaagcacaatgatgctaatggagaaggtggctgtgatggatc

SEQ ID NO: 185 - DNA, 5111 bp, Artificial sequence
  Synthetic construct, pAL409
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgggcggttaattaactaatcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgagagctttgcgttctctaatcgcctcgtcaagcctaggtgtgtgtccggagtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagggatccaccggtccgatcgagcttactgaaaaaattaacatctcttgctaagctgggagcgctagctccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgcccgggcgggcgaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtc

SEQ ID NO: 186 - DNA, 9983 bp, Artificial sequence
  Synthetic construct, pAG2004
ccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaagtctaactcgagttactggtacgtaccaaatccatggaatcaaggtaccatcaatcccgggtattcatcctaggtatccaagaattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatgcagaaactcattaactcagtgcaaaactatgcctggggcagcaaaacggcgttgactgaactttatggtatggaaaatccgtccagccag

SEQ ID NO: 187 - DNA, 12936 bp, Artificial sequence
  Synthetic construct, pAG2100
atccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaactaatcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgagagctttgcgttctctaatcgcctcgtcaagcctagcgctaaggaagggagagatatccatccggatcccggaagccgaatccatccatccatccatcccatactgcccttacgatcgagctgtttgatattcgtgcagatgagcggattctccgcggcagctgctgcggccgagcgcttgtcggaaggttcaccctggatgccaactccgagcttaaggtgacattgaacccagcaccgcagggttcggtggtggagatcaatctagaggcaactaacaccagcggctccctgatactgcattggggcgcccttcgcccggatagaggagaatggctcctaccatcccggagtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagggatccaccgggatggtaggagccattctcctctatccgggcgaagggcgccccaatgcagtatcagggagccgctggtgttagttgcctctagattgatctccaccaccgaaccctgcggtgctgggttcaatgtcaccttaagctcggagttggcatccagggtgaaccttccgacaagcgctcggccgcagcagctgccgcggagaatccgctcatctgcacgaatatcaaacagctcgatcgtaagggcagtatgggatggatggatggatggattcggcttccgggatccggatggatatctctcccttccttagcgctagctccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgcccgggtattcatcctaggtatccaagaattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccag

SEQ ID NO: 188 - DNA, 13462 bp, Artificial sequence
  Synthetic construct, pAG2101
atccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaactaatcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgagagctttgcgttctctaatcgcctcgtcaagcctagcagcagatctagttgaccaagcaagagataatggattattgggtattattggaatttttgtttggattaggttcatggctacaaggcaactaatatggaacaagaactacaatgtgaagccacgtgagataagcaaagcacaagataggtttacagatgatcttgagaatatgtacagaacttacccacaatatcaggagatcttaagaatgataatgtctgctgttggtcggggaggtgaaggtgatgttggtcaacgcattcgtgatgagatattagtaatccagagaaataatgactgcaaaggtggaatgatggaggagtggcaccagaaactgcacaacaatacaagcccagatgatgtagtgatctgccaggccctacttgattatatcaagagtgattttgatattggtgtttactgggacaccttgaaaaaagatggtataacaaaagagcgtctattgagctatgatcgaccgattcattcagagccaaatttcaggagtgaacagaaagatggcttactccgtgacttgggcaattatatgagaagcctcaagatggagggtacccggagtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagggatccaccgggtaccctccatcttgaggcttctcatataattgcccaagtcacggagtaagccatctttctgttcactcctgaaatttggctctgaatgaatcggtcgatcatagctcaatagacgctcttttgttataccatcttttttcaaggtgtcccagtaaacaccaatatcaaaatcactcttgatataatcaagtagggcctggcagatcactacatcatctgggcttgtattgttgtgcagtttctggtgccactcctccatcattccacctttgcagtcattatttctctggattactaatatctcatcacgaatgcgttgaccaacatcaccttcacctccccgaccaacagcagacattatcattcttaagatctcctgatattgtgggtaagttctgtacatattctcaagatcatctgtaaacctatcttgtgctttgcttatctcacgtggcttcacattgtagttcttgttccatattagttgccttgtagccatgaacctaatccaaacaaaaattccaataatacccaataatccattatctcttgcttggtcaactagatctgctgctagctccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgcccgggtattcatcctaggtatccaagaattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccag

SEQ ID NO: 189 - DNA, 13078 bp, Artificial sequence
  Synthetic construct, pAG2102
atccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaactaatcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgagagctttgcgttctctaatcgcctcgtcaagcctagcctccaatcgtgggatccaggtccatgaggcggccctcgccgctcaatctgacgatggttcgtggcgggagtcgccgatcaaacactgtcaaaaccgcatccggggcgtctacttctagcgccgagagtggcgcagtggaggcgggcacggagaaatccgatacgtacagcaccaacatgacgcaagctatgggagcagtgttgacgtatagacatgagcttggaatgaactacaatttcatacgcccagacttgatcgtgggctcctgcttacagagcccacttgatgttgataaacttagggacattggtgtaaaaacagtattctgcctgcagcaagatccagaccttgaatattttggagttgacatctgtgccattcccggagtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagggatccaccgggaatggcacagatgtcaactccaaaatattcaaggtctggatcttgctgcaggcagaatactgtttttacaccaatgtccctaagtttatcaacatcaagtgggctctgtaagcaggagcccacgatcaagtctgggcgtatgaaattgtagttcattccaagctcatgtctatacgtcaacactgctcccatagcttgcgtcatgttggtgctgtacgtatcggatttctccgtgcccgcctccactgcgccactctcggcgctagaagtagacgccccggatgcggttttgacagtgtttgatcggcgactcccgccacgaaccatcgtcagattgagcggcgagggccgcctcatggacctggatcccacgattggaggctagctccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgcccgggtattcatcctaggtatccaagaattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccag

SEQ ID NO: 190 - DNA, 13330 bp, Artificial sequence
  Synthetic construct, pAG2103
atccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaactaatcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgagagctttgcgttctctaatcgcctcgtcaagcctagcgaatacactgaactgcaaccatcctgttgtcaaggagctcattcttgacagcttgagacactgggttgaggagtatcacatagatggatttcgatttgaccttgcaagtgttctttgtcgtggaccagatggttgtcctcttgatgcacctccactcatcaaggaaattgccaaagatgctgtattatctagatgtaagatcattgctgaaccttgggattgcggcggcctttatctcgtagggcgtttccctaactgggacaggtgggctgaatggaacggcaaatacagagatgatcttcgaagatttattaagggtgaccctggtatgaagggggtgtttgcgactcgtgtgtctggatctgctgatctctatcaggtgaacgagcggaagccttaccatggtgtaaattttgtgattgcacatgatggatttactttatgtgaccttgtttcttacaacttaaagcacaatgatgctaatggagaaggtggctgtgatggatcccggagtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagggatccaccgggatccatcacagccaccttctccattagcatcattgtgctttaagttgtaagaaacaaggtcacataaagtaaatccatcatgtgcaatcacaaaatttacaccatggtaaggcttccgctcgttcacctgatagagatcagcagatccagacacacgagtcgcaaacacccccttcataccagggtcacccttaataaatcttcgaagatcatctctgtatttgccgttccattcagcccacctgtcccagttagggaaacgccctacgagataaaggccgccgcaatcccaaggttcagcaatgatcttacatctagataatacagcatctttggcaatttccttgatgagtggaggtgcatcaagaggacaaccatctggtccacgacaaagaacacttgcaaggtcaaatcgaaatccatctatgtgatactcctcaacccagtgtctcaagctgtcaagaatgagctccttgacaacaggatggttgcagttcagtgtattcgctagctccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgcccgggtattcatcctaggtatccaagaattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccag

SEQ ID NO: 191 - DNA, 13731 bp, Sorghum bicolor
  misc_feature (1)..(13731): Sorghum bicolor GWD gene-1
aacctgatggaacgacggtgtacaagaacagggctcttaggacgccttttgtaaaggtcagtcgtcctgcatcaatgatctttgtgctaccacggaacagtagttactaatgtctataactgtgcagtctggtgataactctactcttagaattgagatagatgatcctgcggtgcaagctattgagttcctcatctttggcgagacacagaacaaatggtaatgctgctgtttggattactgtgtaccactgcgtgagtgcttgtttatttgaatgcacaagatatcaaccatctgaactctactttggacaggtttaaaaacaatggccagaattttcagattcagctccagtcgagccgccatcagggtaatggtgcatctggtgcctcctcttctgctacttctaccttggtgccagaggatcttgtgcagatccaagcttaccttcggtgggaaagaaagggaaagcagtcatacacaccagagcaagaaaaggcaagcttttagtactaaacttttcatcgtccatccggaaggaacttgatgcactaagttattagttagctaaagataggtagctgttgcatttttctccaggaggagtatgaagctgcacgagctgagttaatagaggaattaaatagaggtgtttctttagagaagcttcgagctaaattgacaaaaacacctgaagcacctgagtcagatgaacgtaaatctcctgcatctcgaatgcccgttgataaacttccagaggaccttgtacaggtgcaggcttatataaggtgggagaaagcgggcaagccaaattatcctcctgagaagcaactggtaatacattgattcaacagcgtaaaatagcttgttggcttaacgcttcatggaggttcttatttcataatttgctaggtagaacttgaggaagcaaggaaggaactgcaggctgaggtggacaagggaatctctattgatcaattgaggcagaaaattttgaaaggaaacattgagagtaaagtttccaagcagctgaagaacaagaagtacttctctgtagaaaggattcagcgcaaaaagagagatatcatgcaacttctcagtaaacataagcatacagttatggaagagaaagtagaggttgcaccaaaacaaccaactgttcttgatctcttcaccaagtctttacatgagaaggatggctgtgaagttctaagcagaaagctcttcaagttcggtgataaagagatactggttaggatccttgacagattctttgcatttcccgcccttgcttccaccaggctaattaagcttctcccttcttaaggcaatttccaccaaggttcaaaataaaacagaagttcacttggcaacaaaccatacggagccacttattcttcactggtctttggcaaaaaaggctggagaatggaaggtaaaaccccaaaatcttttccattttttaaagctgcaagaagctgtattaaacactgttatcagtgccaatgcggtgttatttaactgtgcaggcacctccttcaaatatattgccatctggttccaaattgctagacatggcgtgtgaaactgaatttactagatctgaattggatggtttgtgttaccaggtggaactaacaccgtcaacttgttttaattccctctttatattagccgtcttgccatctcaaggttcttattgtccaggttgttgagatagagcttgatgatggaggatacaaaggaatgccatttgttcttaggtctggtgaaacatggataaaaaataatggttccgattttttcctagatttcagcacccgtgataccagaaatattaaggcaattgcttctgtccactttaccttgcaaacttcatactgcttcttctgctttgactgttttacagtctcttacttgtaaaactctccaatttgttcttagttaaaggacaatggcgatgctggtaaaggcactgctaaggcgttgctggagagaatagcagatctggaggaagatgcccagcgatctcttatgcataggtcaggcactaaattatccataatgatatgactgcctttttcatggaaagttctcctaaactacttctttcttcaacaggttcaatattgcagcagatctagctgacgaagccagagatgctggactgttgggtattgttggactttttgtttggattaggttcatggctaccaggcaactaacatggaataagaactataatgtgaagccacggtatatacctgtttttattatttacttaagtaaccttttactctctgtttaaaataatcagaaattgtccttttcttttggcatgcgaacctaatttgactgttggtcatcataaatgacaaaacagtatacaattaatagttgtagaatattgtatagatacaaacaaaaacataactctcataatgttcaataaccatgcagtgagataagcaaagcacaagataggtttacagatgatcttgagaatatgtacagaacttatcctcagtacagagagatactaagaatgataatggctgctgttggtcgtggaggtgaaggtgacgttggtcaacgcattcgtgatgagatattagtaatacaggtaaaactgatggtccttggtgaatatacagttattttcgttcattgctctgctgaattgagcagttggtagtgctcatccaaaacgtagacattgtcaacaataaaatgtttggtgtgttacagagaaataatgactgcaaaggtggaatgatggaagaatggcaccagaaattgcacaacaatacaagcccagatgatgtagtgatatgccaggtattggatgcttcgaattcttaatactgcaaaatttaggctttgaggttttgacggtttcatctctccttgggcaggcattaattgattatataaaaaatgattttgatataagcgtttactgggacaccttgaacaaaaatggcataaccaaagagcgtctcttgagctatgatcgtgctattcattcagaaccaaatttcagaagtgaacagaaggagggtttactccgtgacctgggaaattacatgagaagcctaaaggtatgtgacacagctaatatggataataaaaggtaggggaaaattgtgccttatgtttgaaatgagtatagttttgcaaagacaacatatgaaaacacatattgtgctatcaattcagaaaaaaaggataaaaaaatatacagacaaattgtatactagtttacctttttctgctaatggtatatgctgttctgtccagtatatgctttcaatagtaatatttctagctttgacaatgtgcaaaaaccctggtatgcccattactgtatgaacttgtccttgagtctcctcattttttccttatccatataacagcttatccttgaatctccagtgaaacctcctgattttaaccaatttcaatgtaaaaaaaaaatccatatctttgcctttatacattttctttatgagaaaagagtgaaacaaacacagttctaaaatcaggtaagaacttccaaataatttttcacttctaatctattgatgtgcagctctcctatgtttttcgagaaaaaaaaccctcaaaataatttaacagtttgatgtatggtgctagaatcatatagttagttgctaatcatcgcattgtgttcaatctagcaccgactcccagttgcagtagatcaaattattttacctttttttggtcaaacataagtgataaatacagttattcgtttttttaaaaaaactatataattccctcatttttagatttctctgcttgatgctattattggaaaaaacaccccatctcatatatatctaaggaaatttccaggggctaacttttgtgttctttgctgaggcatacttattcgattgcatagctggccaagttaacatagacatgtgatgtttatttattaatttcatttatgtcattgtgatccttcttctacagccagcacaacaagaaggctacctcagctagccacgccgagtaggtcaaccagttagctgctggctattttgcttgatggttaagttagtgaagggatcagataataaggattgttagggccttatgggtttgtttcaggttggtttattaggatattagttagtgctacccttgctctataaaaggggatttgcttttcttgaataaagcatgcagaattaaattgaatccttctccctcttcgatttctaccttgctgttgcagccatgctgatgtggtctagggccacatcctctggtcgaccatacctatggcctaagttctaattcactctaagacagctaagctagtgagaataaatatgatgctgtcccaattatgctagtgcatgattttcttatggcttgccattcgaaataaatgctggacagcagatagatcagcacaaagaggcctcccttatccaggacaagtgtgtgctgtgtgaccaagatgaagaatcagtccagcacatcctctccacttgtgtatttgcttgacagttctgaactgttagaacgccttggtcttgaaagagttgcaccccgatacaatgaactgagatttgcagattggtggaggaagacaagtcagaagatagaaaagacaaggaaaaaggggtttaactgtgttgtgattttgggtgcttggacactttggattcagagtaacaaatgtgtctttgatggcgcctctcctctcagagatgctcaataatacttttaggaagagatgagaatgtggagtatggctggagcatgaaagctccaagagttggtcgttcttccctagtaataggcgatttgtctcacgttcttttgttgcaacctgcccttgacatcctgttggttcaaggggtgattggtatatacccctgacttctttttgggttaagggtggtgtgtgtttcttttgttgggcagttttttcctctctatatataaagatgtgcagttctcctgtgcactcgagaaaagtcactgtttgcctagtggagtgtctggatcgtctatatgacacttagatcctaattgagacccaagtctggcttctaggaagtatggatgtgcaattagaacttagattctgattagttaagattaatcactagccgtgaagtggtcgtttgtctagtgtgttgtgtagataatactggtcacgttgtaacttttttttgtgacaaaaaaagaagatatacatttactcatcttttctgtgattgaatgttctttccctgacataatgtttgattaatgctattatgtttttctcattctgttaggctgtgcattctggtgctgatcttgaatctgctatagcaacttgtatgggatacaaatcagaggtatcatcctcatccctgtttgttctgctacaatgctttacatacctgtgctcatttctaatgaactaactttttggatacagggtgaaggtttcatggttggcgttcagatcaatccagtgaagggtttgccatctggatttcctgtaaaaatctctcaactccttttcgcaaaacatgtaccttcatagtttcttacatttgtgacatttactgcctggtacaggagttgcttgaatttgtgcttgaccatgttgaggataaatcagcagaaccacttcttgaggtcagtgataatagatccaagttcatggtttctaataaaacaaagagcagatgctaggattcattgtctcaattcaaacagctagatctccataactgactgaattctttagtgcatccatttttgtggttttgctttgtggatcagttattgacaacaaattgttaacttataggggctattggaagctcgagttgatctgcgccctttgcttcttgattcgcctgaacgcatgaaagatcttatatttttggacattgctcttgattctaccttcaggacagcaattgaaaggtcatatgaggagctcaatgatgcagccccagaggttggtcaccagaagtattgctatagaagacattattaaatgcaccttttcccgtatcgcatgttgcttttagctttttccaaatgcattatctcatgatgccctttttctcaatccagaaaataatgtacttcatcagtcttgtccttgaaaatcttgcgttttcaattgacgacaatgaagacatcctgtattgcttaaaggtacacttcgagtctttattatccagaaatacaaagatttttatagtggagtttacattattttgtgaattaataatcaaattgatatgcatgtcctaatctagttgtttatgtagattagatagactctgcaaatttcatttttcttgttttctatttcttgtttcttgaccatgtgcctttcttaaaaatgttttctccaaaatctctagaaaattattcatattttgatatacttcaaataagtaccatgccaaaatttgctaacgaaaagacgcagatagagcactattaagtaataccatactgctgttgaaatccttactttgatcactgcaagtaagaggggaatgttatttgcctcagcatggtcattaacaagtagtgtatgaactctgtcctatatattttgatactacattttagtgacagctattaattttgttgtattatggatttacatttcattttttgtgtgcctttagcactttgttattattcagcacattaaacacatggatggtcaaagtttcaactgtttgaatcacatggatacagaagtgacacttgttttacgagggcatttgtgctatctagaaacaattgtttgtttgaacttatttgtgattctattttgtgatgcttaacaatggtgatgttgtctaaatgtttttttcctgaagggatggaaccaagccttggaaatggctaagcaaaaagacgaccaatgggctctttacgctaaagcatttcttgacagaatcagacttgcccttgcgagcaagggagaacagtaccataatatgatgcagccctcagctgaatatcttggctcgttactcagcatagacaaatgggcagtgagtacttcatagaaatcaaatctaatgttccatttgttcatcaagaaattaataataaatatcactttttttcaggtcaatatcttcacagaagaaattatacgcggtggatcagctgctactctgtccgctcttctgaaccgatttgatcctgttctaaggaacgttgctaaccttggaaggtaaaaatgtaaaatctatgactactgttgaacttcttacattgtctccccggtaaatgaacacataattctaaaagtggtactagtgacctctccacagttttatgtgaaccacagaaattaaatatgataatatattctattactctgcacctgacatctggctcctgataacagttggcaggttataagcccagttgaagtatcaggttatgtggttgtggttgatgagttacttgctgtccagaacaaatcttatgataaaccaaccatccttgtggcaaagagtgtcaagggagaggaagaaataccagatggagtagttggtgtaattacacctgatatgccagatgttctgtcccatgtgtcagtccgagcaaggaatagcaaggtttattttcacagttatgttgcaagctttctcagattttttttcttgtatcgatgttgacataccagttttttcctaatgatgaaggtactgtttgcaacctgttttgaccataccactctgtctgaacttgaaggatatgatcagaaactgctttccttcaagcctacttctgcagatataacctataggtacttgaggttatttgaacttcattcatgtctaatgaagctaggttataaaggctaataactaattattttttaatatttccttccatcagcttgttcattcatttggtaacttagatccatacatccatacatattgatattttgaaagacaattttgggttgtttttcctaaaatatgcagtgtatcattgcattaacaaaggaaattgaaaaggtaccacgcaaacacactaccacgaaaacaacacacttgcaacacctacattaaccaggtccagggattccaacgtgcaacactgaataaaaataaagaaagcaactaaagtaatttttgtgttgttattaatgacatacaggatatgtctataggggtaatataggggtgtttggttctccgccgacgtaagccacgccatagactgtggtggcggttctgtggctgctgcttggttcctgtcaaaactgtggctgccactactactcccagcacaaaataacaccacacctgtgcgctgaaattcggcgcctaaccttcggtgccgccgttgttgcggcatggcaacccatggccaggaaccaagcagacccacaatcttcttctgtgtaaacgacaagtgtctatatacctgcctaattatcaccgtgtttgagaaaaaaaaacttcatactttacacaatttatatggtcaagctacacttgatggcacaccatcaactttggccaatatctgactgagtggtcccatgttaccaacatttcacagctgatctggtattatctgttacatgctcacatctcatatcttgcattcaatagggagatcacagagagtgagcttcagcaatcaagttctccaaatgcagaagttggccatgcagtaccatctatttcattggccaagaagaaatttcttggaaaatatgcaatatcagctgaagaattcaccgaggaaatggtacataatataaacttttgcataaggagttcttttcattgaaaagaaaagctttgatgaaaccagctgttagtatgctggttttcttttcttttggccttgtgcttatgctcacatttctattttcaggttggggccaagtctcggaatatagcatacctcaaaggaaaagtaccttcatgggttggtgttccaacgtcagttgcgataccatttggcacttttgagaaggttttgtcagatggtcttaataaggtcagtttctggttcttttttaacattatacttgaacaatagcgctatatatttgttggagaagtctgtttctttaaaatacactattgggaagctatcaatgtgcacttaaatgtccaccaatttctaaggggccattttggtattcaaaacaccaatgcattttttcagagcctgctctgtaagtagcatcttcagtagtatgtatttcatagctttatattctcattctaccatgaactctaattttctaaagctaaactacatatacgcttgaaataagctatgatgttattatctttgatggtaaatgaccctaccatgctcatcggaaggtgtctttagacaggaacaaagcaaatgataacaagaagcctcttcttagggatttgttgtgcagtttgaactagtgttctccccccccccccccccccctctttttcctcgaatatgcaggagagctgcgtatcattgtattaagagaggaaaaaacggtcctgtataattgtactccctactctgcgctgagctgtaggagggtcctaaaacatagtttttctaaccgataaaagcacacactctaggtgagacctgaccaatgctgtaacccccttgttctgtcttttttttttgtttctttctttttcttttctacggtttccttataaaaaaaatatcagttggggaccctctgctgtttcatcaaaaacgatctgccttatattccattgttcttttatggcaggaagtagcacaaaccatagagaagcttaagatcaggcttgctcaagaagattttagtgctctaggtgaaataagaaaagccgttcttaatcttactgctcctatgcaattggtaagatatctctatattcttatatttgttgcaattaagacttaattatgacattgatctttttattattccatgtatgccttattttgtgtctcaggttaatgagctgaaggagaggatgctaggctctggaatgccctggcctggtgatgaaggcaacaggcgctgggagcaagcatggatggctattaaaaaggtaccctcatctacaattaatactagtaattgatccataagtttcggcatatccttgtaggtcattagcttaggaacaccaggggctttaacttttaagttgtacctctttgcctttattcgtggggtcacttgatcccacagattgtagatagatcgattacaagtaagcaatatgcatggaaaattgaatctaagaaaatatttttcctagtatgatcattgtatatctcaatttcctttttaggtttgggcatcaaaatggaatgaaagagcatattttagcacacgcaaggtgaaactcaatcatgagtacctttcgatggctgttcttgtgcaagaagttgtgaatgcagattatgcttttgtcattcatactacaaacccatcgtctggagattcttctgagatatatgctgaagtcgtgaaagggctcggagagactctcgtgggagcctatcctggtcgtgctatgagctttgtttgcaaaaaagatgaccttgactctcccaaggttagttcttggaaattgtcttatggtaggctaatatcatgcaatccgcttcagttgggaagttgatgaatttattatattgtgtgctggtctttctctgccccgcctgcgggtaatttatcacttatcaaaaattttcttacttataaagtagactgcatatgaacatactttatacataggtaaactggtaaaaacatgtaaattaatcggggaaattttcatggtcagtaggtcccccaaccagattgcaaatttgctactaaggatatggtttacctggtttgccagatctaatctgttgcccatttgtagttacttggttacccgagcaagccaattggtctcttcataaggcgatcgatcatctttcgttctgactccaacggcgaggatctggaaggttatgccggagcaggattatatgataggttagggaaatcccattcttgaatgtatgttaaggtgcttattggtttggaatgacagataaattgtctgtttcttcagtgtaccgatggatgaggaggatgaagtcgtacttgattacacaactgaccctcttatagtagatcgtggattccgaaattcaatactctcaagcatcgcacgggctggccatgccattgaagagctatatggttctcctcaggacgtcgagggtgtagtgaaggatggaaaaatctatgtagtccagacaagaccacagatgtagcatgtatgtattagctagctcaataagcactgttgtacgcttgtatggttgggacatatgggtgttatggcatgtatagtttatgcctagatgtacaacacgtgtaaactcttatatatgtatatatgctgaaacaagcattggtcctgcaatttcattgtgaccagtctttgaaaatgaacatgccgacttattgggcaaaaaaaagtttacattcatacttgtgcaaatattttctaaagatgttgaaaagtgtaaccagcttctcatgagtataccagagttataccagttagagcagtgtgctcggggatctcttgctagtccgtgttttttttttattttgaaaaggaagtatggaggggagagattccccgcctagatttcattaaaatcgggagaaaagttcaggatacaaagcataaattaggagctaatcgaagccctgattagaagtacaagaatgtaaaccaaaacagcacccccagcataagggccagattgtggcatatgtttcaccagtacaacaaatagagaaaaagaaaactacaacaccaagtcacgggaggtggatgatgatgcgacataatcatcatcagccaagcaacaagaggtgacgccataggagcttggcagggctttcaacagtggggttgaaatgggccgactatagagaaacggtagcaagagattttgtagcgatgccttgaaggagatgattgtcgctagcgactcacctgaggcgagctttcacctagaacctttatcagtactcctactgacccatccgtgacaaatggaggtgcacgcaccgacgagcaaccgtaccttgccacacctcgtggagttgtttccggactcgcccacgatgatgggaggcatgcaccgcatggacagaggagggggtgttggtcaccaccccaccgtgtggagccgttgtgagactcaccctcgcctgcaatgatgggaggtgcgcaccgacaattgtccatgcttggataggtgttggtgctagccacctccacacctcgcgaagttgttctcagacttgcccgtgttggtgggcggcacacacccacaattatccgcgcttggacgatggtggtgccgaccacctccatacctcacggagccattcttggtctcacccgcgtcggtgggaggtgtgcaccggcaatcgtttgaacgggggtggcggtgttggccgcctccacaccttgtggaaccgttctcggactcgcccatgatggtaggaggcgggcactggcagtcgtccgtgcctagacgaggtggtgctagccgcctccacacctcgtggagctgttcgctgacttgcccgtgtcaatgggaggtgcgcatcgacagttatctacgtctggactggaggtgccgcccgcctctaggagtcggtcgccgccacacaaggagccgctgtcagactcgcttgcgatggtgggaggggcgtactgcagacgtccacgcctagacggagggggtgccagacgcccacgcctgtgccgtcgctggcccgaggcggtggcagcagccaaccgagcacgtagaggaggtgagagtatttaggccttatttagttcacatcaaaaaccaaaaaaatttcaagattccccatcacatcgaatactgcggcacatgcatgaagtactaaatatagatgaaaaaaaactaattgcacattttacctgtaaatcgcgagataaatcttttgagttttgttagttcatgattggacaatgtttgtcaaatacaaacgaaaatgctacggtaccaaaaccccaaacttagttgtcacttaaatggttctgccggtccttgttcgaatcctggtacaatttcttcagtgcccaagggcatcttccccggttgtggccttgtttactttgcgaaaagaaaactgttgggtgtctaatcgaatataccggcacatatttgaaatactaaatgcacacatttaaagtatttaatgctctatacatgtgtcgaaagatttaatggaatggataaaaagtgcagaaattgagaaagttcctgcgaatatctactctatgaaaaggacagctatttggaaatatctacagaaaatatctgaacagaactatccccattagctgggaaaaaccaaagacagaaggaaatcaccacagtccatacagaaatggtagggttctttggcacctctgctgcatctgatcactgtcatttgctaccaaaaaatggatcagttcaccatgaactgataagaccacaccataacagatcaagaagtgtgatcaggtgctgcagcgcagcaaggggaaggaccagggattattactaccaggtgctcggtatcacagttcattccacacctcaggaaatcaaggaggcttacaggaaactccagaa

SEQ ID NO: 192 - DNA, 984 bp, Sorghum bicolor
  misc_feature (1)..(984): Portion of putative sorghum bicolor GWD gene
acaggttcaatattgcagcagatctagctgacgaagccagagatgctggactgttgggtattgttggactttttgtttggattaggttcatggctaccaggcaactaacatggaataagaactataatgtgaagccacggtatatacctgtttttattatttacttaagtaaccttttactctctgtttaaaataatcagaaattgtccttttcttttggcatgcgaacctaatttgactgttggtcatcataaatgacaaaacagtatacaattaatagttgtagaatattgtatagatacaaacaaaaacataactctcataatgttcaataaccatgcagtgagataagcaaagcacaagataggtttacagatgatcttgagaatatgtacagaacttatcctcagtacagagagatactaagaatgataatggctgctgttggtcgtggaggtgaaggtgacgttggtcaacgcattcgtgatgagatattagtaatacaggtaaaactgatggtccttggtgaatatacagttattttcgttcattgctctgctgaattgagcagttggtagtgctcatccaaaacgtagacattgtcaacaataaaatgtttggtgtgttacagagaaataatgactgcaaaggtggaatgatggaagaatggcaccagaaattgcacaacaatacaagcccagatgatgtagtgatatgccaggtattggatgcttcgaattcttaatactgcaaaatttaggctttgaggttttgacggtttcatctctccttgggcaggcattaattgattatataaaaaatgattttgatataagcgtttactgggacaccttgaacaaaaatggcataaccaaagagcgtctcttgagctatgatcgtgctattcattcagaaccaaatttcagaagtgaacagaaggagggtttactccgtgacctgggaaattacatgagaagcctaaag

SEQ ID NO: 193 - DNA, 344 bp, Artificial sequence
  Synthetic construct, sbGWDk02a
ggttcaataacccgggagtgagataagcaaagcacaagataggtttacagatgatcttgagaatatgtacagaacttatcctcagtacagagagatactaagaatgataatggctgctgttggtcgtggaggtgaaggtgacgttggtcaacgcattcgtgatgagatattagtaatacaggtaaaactgatggtccttggtgaatatacagttattttcgttcattgctctgctgaattgagcagttggtagtgctcatccaaaacgtagacattgtcaacaataaaatgtttggtgtgttacagagaaataccggtgcaaagctagcatgatggaagaatgg

SEQ ID NO: 194 - DNA, 197 bp, Artificial sequence
  Synthetic construct, sbGWDk2b
ggttcaataagctagcagtgagataagcaaagcacaagataggtttacagatgatcttgagaatatgtacagaacttatcctcagtacagagagatactaagaatgataatggctgctgttggtcgtggaggtgaaggtgacgttggtcaacgcattcgtgatgagatattagtaatacagcccgggctgatggtcc

SEQ ID NO: 195 - DNA, 12767 bp, Artificial sequence
  Synthetic construct, pAG2106
atccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaactaatcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgagagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagggatccaccgggagtgagataagcaaagcacaagataggtttacagatgatcttgagaatatgtacagaacttatcctcagtacagagagatactaagaatgataatggctgctgttggtcgtggaggtgaaggtgacgttggtcaacgcattcgtgatgagatattagtaatacaggtaaaactgatggtccttggtgaatatacagttattttcgttcattgctctgctgaattgagcagttggtagtgctcatccaaaacgtagacattgtcaacaataaaatgtttggtgtgttacagagaaataccgggctgtattactaatatctcatcacgaatgcgttgaccaacgtcaccttcacctccacgaccaacagcagccattatcattcttagtatctctctgtactgaggataagttctgtacatattctcaagatcatctgtaaacctatcttgtgctttgcttatctcactgctagctccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgcccgggtattcatcctaggtatccaagaattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccag

SEQ ID NO: 196 - DNA, 39 bp, Oryza sativa
  misc_feature (1)..(39): OsGWD excerpt 1
tggaatttttgtttggattaggttcatggctacaaggca

SEQ ID NO: 197 - DNA, 39 bp, Sorghum bicolor
  misc_feature (1)..(39): sbGWD excerpt 1
tggactttttgtttggattaggttcatggctaccaggca

SEQ ID NO: 198 - DNA, 38 bp, Zea mays
  misc_feature (1)..(38): ZmGWD excerpt 1, n, is any nucleotide
nnnnnnnnnnnnnnnnnnngattcatggctaccaggca

SEQ ID NO: 199 - DNA, 39 bp, Solanum lycopersicon
  misc_feature (1)..(39): SlGWD excerpt 1
tggaattcttgtatggatgaggttcatggctacaaggca

SEQ ID NO: 200 - DNA, 42 bp, Oryza sativa
  misc_feature (1)..(42): OsGWD excerpt 2
agagcgtctattgagctatgatcgaccgattcattcagagcc

SEQ ID NO: 201 - DNA, 42 bp, Sorghum bicolor
  misc_feature (1)..(42): SbGWD excerpt 2
agagcgtctcttgagctatgatcgtgctattcattcagaacc

SEQ ID NO: 202 - DNA, 42 bp, Zea mays; identical to SEQ ID NO: 201
  misc_feature (1)..(42): ZmGWD excerpt 2

SEQ ID NO: 203 - DNA, 42 bp, Solanum lycopersicon
  misc_feature (1)..(42): SlGWD excerpt 2
agagcgtcttttgagttatgaccgtgctatccattctgaacc

SEQ ID NO: 204 - DNA, 39 bp, Artificial sequence
  Synthetic construct, dgGWDup2 (PCR Primer)
  misc_feature (8)..(8): Y is C or T
  misc_feature (13)..(13): W is A or T
  misc_feature (19)..(19): K is G or T
  misc_feature (22)..(22): R is A or G
  misc_feature (34)..(34): M is A or C
tggaattyttgtwtggatkagrttcatggctacmaggca

SEQ ID NO: 205 - DNA, 42 bp, Artificial sequence
  Synthetic construct, dgGWD down 2 (PCR Primer)
  misc_feature (3)..(3): Y is C or T
  misc_feature (6)..(6): W is A or T
  misc_feature (12)..(12): R is A or G
  misc_feature (15)..(15): M is A or C
  misc_feature (17)..(17): S is G or C
  misc_feature (18)..(18): W is A or T
  misc_feature (21)..(21): R is A or G
  misc_feature (27)..(27): R is A or G
  misc_feature (33)..(33): D is A, G or T
ggytcwgaatgratmgswcgrtcatarctcaadagacgctct

SEQ ID NO: 206 - DNA, 1130 bp, Panicum virgatum
  misc_feature (1)..(1130): PvGWD-2
tggaattcttgtttggatgagattcatggctaccaggcaactaacatggaataagaactataatgtgaagccccggtatatacctgtctttatcatttacttcagtgatgtttactctctgcttaaaaatttaaagaatctgaagctgtccttttcttttgtgcgggaacataattgagaaattggtgtttttgccactacttcatgatgcaattgtaatttttccctcatttttttcaactttgtgattttgccctttactattcacaagtcaacgcaattttgctcctgttttgaccgttgactgagggaaaaatcgcgttaacttgtgaatagtaagtgcaaaattgcaaagttgaaaaaaacaaggacaaaatcacaattgcactgcaaagtaggggtggaaacacaaatgccccaaaataatttggctgtttgtcctgatagaaaacaatacaattcagtactcagagaatattatatttctataaatgaaaaacataactcatgtcacattctttggcatctcatatcgatcaataactatgcagtgagataagcaaagcacaagataggtttacagatgatcttgagaacatgtacaaagcttatcctcagtgcagagagatattaagaatgataatggctgctgttggtcgtggaggtgaaggtgatgttggtcaacgtattcgtgatgagatattagtaatacaggtaaaattaatggtcctaggtgaatatacacttacttttattcattgcttcaccgaattatacggttggtagttctcatccaaaagatagacattgtgaataataataaaatgcttgctgctttaatagagaaataatgactgcaaaggtggaatgatggaagaatggcaccagaaattgcacaacaatacaagcccagatgatgtagtgatatgccaggtaatggatattttgaattcttaatacagtaagtatttaagcattgaggttttcatggttatgtctctccttgggcaggcactaattgattatatcaagagtgattttgatataagtgtttactgggacaccttgaacaaaaatggcataaccaaagagcgtctcttgagctatgatcgagctatccattcagaacc

SEQ ID NO: 207 - DNA, 1130 bp, Panicum virgatum
  misc_feature (1)..(1130): PvGWD-5
tggaattcttgtttggattaggttcatggctaccaggcaactaacatggaataagaactataatgtgaagccccggtatatacctgtctttatcatttacttcagtgatgtttactctctgcttaaaaatttaaagaatctgaagctgtccttttcttttgtgcgggaacatatttgagaaattggtgtttttgccactacttcatgatgcaattgtaatttttccctcatttttttcaactttgtgattttgccctttactattcacaagtcaacgcaattttgctcctgttttgaccgttgactgagggaaaaatcgcgttaacttgtgaatagtaagtgcaaaattgcaaagttgaaaaaaacaaggacaaaatcacaattgcactgcaaagtaggggtggaaacacaaatgccccaaaataatttggctgtttgtcctgatagaaaacaatacaattcagtactaagagaatattatatttctataaatgaaaaacataactcatgtcacattctttggcatctcatatcgatcaataactatgcagtgagataagcaaagcacaagataggtttacagatgatcttgagaacatgtacaaagcttatcctcagtgcagagagatattaagaatgataatggctgctgttggtcgtggaggtgaaggtgatgttggtcaacgtattcgagatgagatattagtaatacaggtaaaattaatggtcctaggtgaatatacacttacttttattcattgcttcactgaattatacggttggtagttctcatccaaaagatagacattgtgaataataataaaatgcttgctgctttaatagagaaataatgactgcaaaggtggaatgatggaagaatggcaccagaaattgcacaacaatacaagcccagatgatgtagtgatatgccaggtaatggatattttgaattcttaatacagtaagtatttaagcattgaggttttcatggttatgtctctccttgggcaggcactaattgattatatcaagagtgattttgatataagtgtttactgggacaccttgaacaaaaatggcataaccaaagagcgtctattgagttatgaccgtccgatccattccagacc

SEQ ID NO: 208 - DNA, 1071 bp, Panicum virgatum
  misc_feature (1)..(1071): PvGWD-1
tggaatttttgtttggatgagattcatggctacaagacaactgacatggaataagaactataatgtgaagccacggtatatacctgtctttattatttacttcagtaatgtttactctctgctttaaaagttaaagaatcagaagttgtccctttcttttgtgcgggaacataattgaaaagttggtgttcttgccactacaagtcaacgcgattttacccctcgtcaacggtcaaaacagtagcaaaatcgcgttgacttgtgaatagtaagggcaaatcacaaagttggaaaaaacaaggacaaaatcacaattgcactgcaaagtagtcgcggaaacacaaatgccccaaaataatttggctgtttgtcctgataaaaaacaatacaattcagtactcagagaatattatatttctataaatgaaaaacataactcatgtcgcattctttcattctttggcatctcatattgattaataactacgcagtgagataagcaaagcacaagataggtttacagatgatcttgagaacatgtacaaagcttatcctcagtacagagagatattaagaatgataatggctgctgttggtcgtggaggtgaaggtgatgttggtcaacgtattcgtgatgagatattagtaatacaggtaaaattaatggtcctaggtgaatatacacctacttttattcattgcttcactgaattatacggttggtagttctgatccaaaagatagacattgtgaataataataaaatgcttgctgcttttatagagaaataatgactgcaaaggtggaatgatggaagaatggcaccagaaattgcacaacaatacaagcccagatgatgtagtgatatgccaggtattggatattttgaattcttaatactgtaagtatttaagcattgaggtttttatggttatgtctctccttgggcaggcattaattgattatatcaagagtgattttgatataagtgtttactgggacaccttgaacaaaaatggcataaccaaagagcgtcttttgagctatgatcgttgctatccattcagaacc

SEQ ID NO: 209 - DNA, 265 bp, Artificial sequence
  Synthetic construct, PvGWDko2 RNAi driver sequence
ggctagcgagataagcaaagcacaagataggtttacagatgatcttgagaacatgtacaaagcttatcctcagtacagagagatattaagaatgataatggctgctgttggtcgtggaggtgaaggtgatgttggtcaacgtattcgtgatgagatattagtaatacaggagaaataatgactgcaaaggtggaatgatggaagaatggcaccagaaattgcacaacaatacaagcccagatgatgtagtgatatgcccgggagg

SEQ ID NO: 210 - DNA, 12930 bp, Artificial sequence
  Synthetic construct, pAG2104
atccagataatgcagaaactcattaactcagtgcaaaactatgcctggggcagcaaaacggcgttgactgaactttatggtatggaaaatccgtccagccagccgatggccgagctgtggatgggcgcacatccgaaaagcagttcacgagtgcagaatgccgccggagatatcgtttcactgcgtgatgtgattgagagtgataaatcgactctgctcggagaggccgttgccaaacgctttggcgaactgcctttcctgttcaaagtattatgcgcagcacagccactctccattcaggttcatccaaacaaacacaattctgaaatcggttttgccaaagaaaatgccgcaggtatcccgatggatgccgccgagcgtaactataaagatcctaaccacaagccggagctggtttttgcgctgacgcctttccttgcgatgaacgcgtttcgtgaattttccgagattgtctccctactccagccggtcgcaggtgcacatccggcgattgctcactttttacaacagcctgatgccgaacgtttaagcgaactgttcgccagcctgttgaatatgcagggtgaagaaaaatcccgcgcgctggcgattttaaaatcggccctcgatagccagcagggtgaaccgtggcaaacgattcgtttaatttctgaattttacccggaagacagcggtctgttctccccgctattgctgaatgtggtgaaattgaaccctggcgaagcgatgttcctgttcgctgaaacaccgcacgcttacctgcaaggcgtggcgctggaagtgatggcaaactccgataacgtgctgcgtgcgggtctgacgcctaaatacattgatattccggaactggttgccaatgtgaaattcgaagccaaaccggctaaccagttgttgacccagccggtgaaacaaggtgcagaactggacttcccgattccagtggatgattttgccttctcgctgcatgaccttagtgataaagaaaccaccattagccagcagagtgccgccattttgttctgcgtcgaaggcgatgcaacgttgtggaaaggttctcagcagttacagcttaaaccgggtgaatcagcgtttattgccgccaacgaatcaccggtgactgtcaaaggccacggccgtttagcgcgtgtttacaacaagctgtaagagcttactgaaaaaattaacatctcttgctaagctgggagctctagatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgaattaattcagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccgggacggcgtcagcgggagagccgttgtaaggcggcagactttgctcatgttaccgatgctattcggaagaacggcaactaagctgccgggtttgaaacacggatgatctcgcggagggtagcatgttgattgtaacgatgacagagcgttgctgcctgtgatcaaatatcatctccctcgcagagatccgaattatcagccttcttattcatttctcgcttaaccgtgacaggctgtcgatcttgagaactatgccgacataataggaaatcgctggataaagccgctgaggaagctgagtggcgctatttctttagaagtgaacgttgacgatcgtcgaccgtaccccgatgaattaattcggacgtacgttctgaacacagctggatacttacttgggcgattgtcatacatgacatcaacaatgtacccgtttgtgtaaccgtctcttggaggttcgtatgacactagtggttcccctcagcttgcgactagatgttgaggcctaacattttattagagagcaggctagttgcttagatacatgatcttcaggccgttatctgtcagggcaagcgaaaattggccatttatgacgaccaatgccccgcagaagctcccatctttgccgccatagacgccgcgccccccttttggggtgtagaacatccttttgccagatgtggaaaagaagttcgttgtcccattgttggcaatgacgtagtagccggcgaaagtgcgagacccatttgcgctatatataagcctacgatttccgttgcgactattgtcgtaattggatgaactattatcgtagttgctctcagagttgtcgtaatttgatggactattgtcgtaattgcttatggagttgtcgtagttgcttggagaaatgtcgtagttggatggggagtagtcatagggaagacgagcttcatccactaaaacaattggcaggtcagcaagtgcctgccccgatgccatcgcaagtacgaggcttagaaccaccttcaacagatcgcgcatagtcttccccagctctctaacgcttgagttaagccgcgccgcgaagcggcgtcggcttgaacgaattgttagacattatttgccgactaccttggtgatctcgcctttcacgtagtgaacaaattcttccaactgatctgcgcgcgaggccaagcgatcttcttgtccaagataagcctgcctagcttcaagtatgacgggctgatactgggccggcaggcgctccattgcccagtcggcagcgacatccttcggcgcgattttgccggttactgcgctgtaccaaatgcgggacaacgtaagcactacatttcgctcatcgccagcccagtcgggcggcgagttccatagcgttaaggtttcatttagcgcctcaaatagatcctgttcaggaaccggatcaaagagttcctccgccgctggacctaccaaggcaacgctatgttctcttgcttttgtcagcaagatagccagatcaatgtcgatcgtggctggctcgaagatacctgcaagaatgtcattgcgctgccattctccaaattgcagttcgcgcttagctggataacgccacggaatgatgtcgtcgtgcacaacaatggtgacttctacagcgcggagaatctcgctctctccaggggaagccgaagtttccaaaaggtcgttgatcaaagctcgccgcgttgtttcatcaagccttacggtcaccgtaaccagcaaatcaatatcactgtgtggcttcaggccgccatccactgcggagccgtacaaatgtacggccagcaacgtcggttcgagatggcgctcgatgacgccaactacctctgatagttgagtcgatacttcggcgatcaccgcttccctcatgatgtttaactcctgaattaagccgcgccgcgaagcggtgtcggcttgaatgaattgttaggcgtcatcctgtgctcccgagaaccagtaccagtacatcgctgtttcgttcgagacttgaggtctagttttatacgtgaacaggtcaatgccgccgagagtaaagccacattttgcgtacaaattgcaggcaggtacattgttcgtttgtgtctctaatcgtatgccaaggagctgtctgcttagtgcccactttttcgcaaattcgatgagactgtgcgcgactcctttgcctcggtgcgtgtgcgacacaacaatgtgttcgatagaggctagatcgttccatgttgagttgagttcaatcttcccgacaagctcttggtcgatgaatgcgccatagcaagcagagtcttcatcagagtcatcatccgagatgtaatccttccggtaggggctcacacttctggtagatagttcaaagccttggtcggataggtgcacatcgaacacttcacgaacaatgaaatggttctcagcatccaatgtttccgccacctgctcagggatcaccgaaatcttcatatgacgcctaacgcctggcacagcggatcgcaaacctggcgcggcttttggcacaaaaggcgtgacaggtttgcgaatccgttgctgccacttgttaacccttttgccagatttggtaactataatttatgttagaggcgaagtcttgggtaaaaactggcctaaaattgctggggatttcaggaaagtaaacatcaccttccggctcgatgtctattgtagatatatgtagtgtatctacttgatcgggggatctgctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggggggggggggggggggttccattgttcattccacggacaaaaacagagaaaggaaacgacagaggccaaaaagctcgctttcagcacctgtcgtttcctttcttttcagagggtattttaaataaaaacattaagttatgacgaagaagaacggaaacgccttaaaccggaaaattttcataaatagcgaaaacccgcgaggtcgccgccccgtaacctgtcggatcaccggaaaggacccgtaaagtgataatgattatcatctacatatcacaacgtgcgtggaggccatcaaaccacgtcaaataatcaattatgacgcaggtatcgtattaattgatctgcatcaacttaacgtaaaaacaacttcagacaatacaaatcagcgacactgaatacggggcaacctcatgtccccccccccccccccctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaagaattggtcgacgatcttgctgcgttcggatattttcgtggagttcccgccacagacccggattgaaggcgagatccagcaactcgcgccagatcatcctgtgacggaactttggcgcgtgatgactggccaggacgtcggccgaaagagcgacaagcagatcacgcttttcgacagcgtcggatttgcgatcgaggatttttcggcgctgcgctacgtccgcgaccgcgttgagggatcaagccacagcagcccactcgaccttctagccgacccagacgagccaagggatctttttggaatgctgctccgtcgtcaggctttccgacgtttgggtggttgaacagaagtcattatcgcacggaatgccaagcactcccgaggggaaccctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaacctgatcatgagcggagaattaagggagtcacgttatgacccccgccgatgacgcgggacaagccgttttacgtttggaactgacagaaccgcaacgttgaaggagccactcagcttaattaactaatcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgagagctttgcgttctctaatcgcctcgtcaagcctagatgcatgctcgagcggccgccagtgtgatggatatctgcagaattcgcccttggctgcgagataagcaaagcacaagataggtttacagatgatcttgagaacatgtacaaagcttatcctcagtacagagagatattaagaatgataatggctgctgttggtcgtggaggtgaaggtgatgttggtcaacgtattcgtgatgagatattagtaatacaggagaaataatgactgcaaaggtggaatgatggaagaatggcaccagaaattgcacaacaatacaagcccagatgatgtagtgatatgcccggagtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagggatccaccgggcatatcactacatcatctgggcttgtattgttgtgcaatttctggtgccattcttccatcattccacctttgcagtcattatttctcctgtattactaatatctcatcacgaatacgttgaccaacatcaccttcacctccacgaccaacagcagccattatcattcttaatatctctctgtactgaggataagctttgtacatgttctcaagatcatctgtaaacctatcttgtgctttgcttatctcgcagccaagggcgaattctgcagatatccatcacactggcggccgctcgagcatgcatctagctccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgcccgggtattcatcctaggtatccaagaattcatactaaagcttgcatgcctgcaggtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccag

SEQ ID NO: 211 - DNA, 30 bp, Panicum virgatum
  misc_feature (1)..(30): PvGWDi-1
ccgtggcttcacattatagttcttattcca

SEQ ID NO: 212 - DNA, 25 bp, Panicum virgatum
  misc_feature (1)..(25): PvGWDi-2
gagataagcaaagcacaagataggt

SEQ ID NO: 213 - DNA, 25 bp, Panicum virgatum
  misc_feature (1)..(25): PvGWDi-3
gcctgcccaaggagagacataacca

SEQ ID NO: 214 - DNA, 25 bp, Panicum virgatum
  misc_feature (1)..(25): PvGWDi-4
gatataagtgtttactgggacacct

SEQ ID NO: 215 - DNA, 7635 bp, Panicum virgatum
  misc_feature (1)..(7635): Switchgrass amalgamated sequence; n, is any nucleotide
ggaacgacagtgtacaagaacagggctcttcggacgccttttctaaaggtcagtcttgttacattatggatctctttgttaccacagaacagtctggttagcagtaatgtccataactgtgcagtcaggaggtgataactccacgcttagaattgagatagatgatcctgcggtgcaagctattgaatttctcatctttgatgagacacagaacaaatggtaacccagctgttttcgttaccatgtagcactgtttgtttgtttgaatgcaaaaggtatataaactatgcaaaactctacattgcacaggtttaaaaataatggccagaattttcaaattcagctccaatcgagccaccatcatggtagtggcgcatctggtgcctcatcttctgctacttctgccttggtgccagaggatcttgtgcagatccaagcttacctacggtgggaaagaaatggaaagcagtcatacacaccggagcaagaaaaggaaagcttttagttgtttttttttatcttcagtctggaaggaactcaatgtactaagttgattaaaaataagaggtggtgtattttttctccaggaggagtatgaagctgcacgagctgagttaatagaagaattaaatagaggtgtttctttggagaagcttcgagctaaattgacaaaagcacctgaagtgcccgactcagatgaaaatgattctcctgcatctcaaattactgttgataaaattccagaggaccttgtacaagtccaggcttatataaggtgggagaaagcaggcaagccaaactatcctcctgagaagcaactggtaatgcattgattcaatagcgtaaaataccttgttggctttacactttatggaggttcttatctcacaattcgctaggtcgagtttgaggaagcaaggaaggaactgcaggctgaggtggacaagggaatctcgattgatcagttgaggaagaagattttgaaaggaaacattgagagtaaagtttcgaagcagctgaagaataagaagtacttctctgtagaaaggattcagcgcaaaaagagagatatcatgcagattcttagtaaacataagcatactgtcatagaagagcaagcagaggttgcaccaaaacaactaactgttcttgatctcttcaccaattcattacagaaggatggctttgaagttctaagcaaaaaactgttcaagttcggtgataaacagatcctggttaggatccttaagatattctttgtatctccagatctttttctaccatgctaattaagcttctctcttcttaaggcaatctccaccaaggttctaaacaaatcaaaagtttacttggcaacaaatcatacggagccacttatccttcactggtcactagcgaaaaaggctggagagtggaaggttaaatttcaaaattgtttccagtagttaaagccacaaactcagcagcttttttaaacactgctatcagtaccaatgcggtgttatttaactgtgcaggcacctccttcaaacatattgccatctggttcaaaattgttagacatggcatgcgaaactgaatttactaagtctgaattggatggtttgcattatcaggtggaaataacatcttcaacctgttattttattcttatttttattagccctcctgctatctcaaggctcttaatttccaggttgttgagatagagcttgatgatggaggatataaagggatgccattcgttcttcggtctggtgaaatgtggataaaaaataatggctctgatttttaccttgatctcagcacccgtgataccagaaatattaaggcaagtgtttctgtccattttacctttcaaactttaaactattgtctttgttttgtctatgcaactagtcgctaaattgtgaagtaaccgatctgttcttaattgaaggacactggtgatgctggtaaaggtactgctaaggcattgctggaaagaatagcagagctggaggaagatgcccagcgatctcttatgcacaggtcaggcactaaaatatccataataatatgactgaattttacatggaaaattctcctaaactacttctactccttgacagattcaacattgcagcagatctagttgaccaagccagagatgctggactattgggtattgttggactttttgtttggattagattcatggctacaagacaactgacatggaataagaactataatgtgaagccacggtatatacctgtctttattatttacttcagtaatgtttactctctgctttaaaagttaaagaatcagaagttgtccctttcttttgtgcgggaacataattgaaaagttggtgttcttgccactacaagtcaacgcgattttacccctcgtcaacggtcaaaacagtagcaaaatcgcgttgacttgtgaatagtaagggcaaatcacaaagttggaaaaaacaaggacaaaatcacaattgcactgcaaagtagtcgcggaaacacaaatgccccaaaataatttggctgtttgtcctgataaaaaacaatacaattcagtactcagagaatattatatttctataaatgaaaaacataactcatgtcgcattctttcattctttggcatctcatattgattaataactacgcagtgagataagcaaagcacaagataggtttacagatgatcttgagaacatgtacaaagcttatcctcagtacagagagatattaagaatgataatggctgctgttggtcgtggaggtgaaggtgatgttggtcaacgtattcgtgatgagatattagtaatacaggtaaaattaatggtcctaggtgaatatacacctacttttattcattgcttcactgaattatacggttggtagttctgatccaaaagatagacattgtgaataataataaaatgcttgctgcttttatagagaaataatgactgcaaaggtggaatgatggaagaatggcaccagaaattgcacaacaatacaagcccagatgatgtagtgatatgccaggtattggatattttgaattcttaatactgtaagtatttaagcattgaggtttttatggttatgtctctccttgggcaggcattaattgattatatcaagagtgattttgatataagtgtttactgggacaccttgaacaaaaatggcataaccaaagagcatctcttgagctatgatcgtgcgattcattcagaaccaaatttcagaagtgaacagaaggagggtttactccatgacctgggtaattacatgagaagcctgaaggtatgtaaaacacttaatatggatataaaaaaaggcatgcaaaaaaatctgtgcattatctttgaaattgagtatggtattttctaaagaaaacatagaaaaacacatattgccctttcagttccggaaaaaaatgatctgccataaagagcatacagtcaactcatgtattagcactcgccttttctgctaatggtatgttgtgttgtgttctgttctattcaatatatgctttcagtaataatattctagtgttgacaacatcattgctcacaacatacagaaactgtagtatgcccggtacagtatgaacttgtccttgagtctcctcattttttccttattcacgtcacagctttatatccttccaatgaataatgatcaacttggaaatcattggcatctacagtgaaccgtccattgtattctgattttgaacaactttttttcccctcagaacacacagtaatagccaagtataacgaccttacatggccaaaacaacaaccttacatggccaaaatagccaggtaagggacagaagaagagagagggttgccctgcggcagatgtggacaatgactgatgatgtggctgtcccagttatcaaaacaggcaaatccactgttcatgtggccnaagccagtaatgagctggttttgggaaaccctgggggattgagtaaacaattagagggttatgtggatttggtcatagttgggggtaggaatttggaaatttcccttttgcttgataattatgttagtcaagagattagacaagtattgttaggagtttgtttcagctggttgagattggatttggtttcttaggtgattggttagtgctacccttgctctataattggggatttgcttttaataaagaaagcagaaataaacccaatccttctccggttctccctcttttgtccgatgtttgcagatgcggccactgataaggtccaggtccatgtcctcccatcaaccacacacacatacagcctaagatctaattcaccccaggacacccaagctcgtgaaaatataccatgtcatcccactattcatactttttttaaaaaaatcccactaatcctgcaaatgtcctaatataagaacaacatcattttcagtcatgttgtaccttttcttggtgacaaaaagaagacatccatttcatctctttttaaggggcattttctcatcgtttctgcaattgaatattctttccctgatgtaatctttgaatgaatgctattgtgatttgctcattctgttaggctgtgcattctggtgctgatcttgagtctgctatagcaacttgcatgggatacaaatcggaggtatcattctcattccttttcattccgctagaattctttagatacctgtgctcatatctaatgaactaacttttgggtacagggtgaaggtttcatggtcggtgttcagatcaatccagtgaagggtttgccatctggatttcctgtaaaaatccctcaccttcttttctcaacacatgtactttctaagtttcttatacttgtgacatttacctttataggaattgctcaaatttgtgcttgaccatgttgaggacaagtcagcggaaccacttcttgaggtcagtgatataatcgaagttcctgtttgtaataaaacgaagagaagaagctgggtttttcatcacaactcaaataatcagatctcacatagctgattgaatttttaaaccaccattttttgcggntactatgngaatcacttgttgctaacaaaatgctaccttgnaggggnnggtggaagctcnagttgaactccnccctnnncttcntgnttcaccngnacgcatgaaagaanntatttttttggncattgcncctgattcnacttttangacagctatngaaaggncatatgangagctccnccatggannccccgangntgggcncccnaatattgnccccatgatnngnnnnangnnnagnnccnnnannnnnnncnnnnnnnnnntnnnnnanannnngnntnnnnnannnnnnnnnnnngnnnnnnnncnnnnnnnnnnnnnnnnnnnnnnnnnnnnnnnaannnnnnnnnnnnnnannnccnnnnnnnnnnnnnnnnannnnnnnnannnnnnnnnnnnnnnnnncnnnnnnaannnnnnnnnatncnnnnnnnnnnnnnnnnnnnnnnnnnnnnnnannnnnnnnnnnnnncnncnnnnnnnnnnnnnntnnnnnnnnannnncaacnnnnnnnnnnnnnnnnnnnccnnnnnnnnngnnnnnnnnnnnnnannnnnnnnnnnnnnnnnannnnnnnnannnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnannnnnnnnnnnnngnnnnnnnnnnnnnnnnnnnnnnnnnnnnnncnnnnnnnnnnnnnnnncnnnnnnnnnnnnnnnannnnnnnnnnnnnnannnnnnnnnnnnnnnnnnnnnnnnnnnnnnnnnnnnnnnnnnnnnnnnnnannnnnnnnnnnnntnnannncnnnnantanncnnnnnnnnntnnnngnnnnnnnnnnnnnnnnnnnnnnnnnngannnnnnnnnnnnnnnnagnnntnnnannnnncnnnnnnnnnngnnntnnnnnnnnnnnnngnnnnnnnnnnnnnnnnnnnnnnntnnnnnnnnnnnnnnnnngnnnnnntnnnnnnnngnnnnnnnncnnnnnnnnnnnnnnnnnnnnnnnnnntnacnnnnnnnnnnnnntcncnnnnnnnnnnnnnnnnnnnnnnnnnnnnnnnnnnnnggcntnnnnnnnnnnnnnnnnnnnnnnnnnnnnnnnnnnnnannnnncnnnnnnnnnncnnnnnnnnnnnnntnnnnnncnnnnncnnnnnnnnnnnnnnnnnnnnnnnnnnnnnnnnnnnntgnnnnnncnnnnnnnnnnnncannncnnnngnagatctcggagagtgaacttcagcaatcaagttctccggatgcagaagctggccatgcagtaccatctatttcattggtcaataagaagtttcttggaaaatatgcaatatcagctgaagaattctctgaggaaatggttagtaatataaaattttgcattaggaaatctgccattcgtaaggaagtcttgatgaaaccaattgttattatgctggtttccttttcttttggccttgtgcttctagtactcacttttatgttttcaggttggggctaagtctcggaatatagcatacctcaaaggaaaagtaccttcgtgggttggtgtcccaacatcagttgcgataccatttggcacttttgagaaggttttatcagatgggcttaataaggttggttggtggtttattttgatgtatatacttgaataatagaactgcatggttcttggagaagtcagattctttaacatgtttgaaatacactactgggaaggtaacaacgtgcaatttaatgtccaccaatatctaaacagccatttttggcattcaattcactatatattttatttcatgagcctgctctataagtagcgtcttcagtagttgtagctcatagcttcatagtctcattctaccatgaactaattttgctaacttacatctactcttgaaataagtaatacttgtatattattatctttgattgtaaaagaacttcccttgctcgtttgtcaaggtgtcttttagacaggagatggaattgactgttatcaaagcaaatgataacaagaaacctcttgttgattggttgagcagtttcaactaatccatttttttttctttttggcatgtgatctttgtattattggcccaaatgaaattctatttctcccattaaccacccacaatggcaggtttgggtacatataggccaaccatgggtaggtggcttaaaagttgagtaaagcataattggggataaggtgcacataggcacggaccacccacagacaaagtgcttgcaggcactactaatacattattctatcaccatcaggattcaattctaacatgtactgtttcttctttttcttctttgtacagttcctgtatagacccttttgtacagtttcctaacaaatgaaaaagatcagtaggagaccctcttctcctgttccacaaaaaatgttaaaatggtctttctaatatttgattgttctttcttttatggcaggaagagcgcaaaacatagaaaagctt

SEQ ID NO: 216 - DNA, 327 bp, Artificial sequence
  Synthetic sequence, sbGWDko2a minus flanking sequence
gtgagataagcaaagcacaagataggtttacagatgatcttgagaatatgtacagaacttatcctcagtacagagagatactaagaatgataatggctgctgttggtcgtggaggtgaaggtgacgttggtcaacgcattcgtgatgagatattagtaatacaggtaaaactgatggtccttggtgaatatacagttattttcgttcattgctctgctgaattgagcagttggtagtgctcatccaaaacgtagacattgtcaacaataaaatgtttggtgtgttacagagaaataccggtgcaaagctagcatgatggaagaatgg

SEQ ID NO: 217 - DNA, 164 bp, Artificial sequence
  Synthetic sequence, antisense sbGWDko2b
ctgtattactaatatctcatcacgaatgcgttgaccaacgtcaccttcacctccacgaccaacagcagccattatcattcttagtatctctctgtactgaggataagttctgtacatattctcaagatcatctgtaaacctatcttgtgctttgcttatctcac

SEQ ID NO: 218 - DNA, 5506 bp, Artificial sequence
  Synthetic sequence, pAL409jSbGWDko2
tagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagggatccaccgggagtgagataagcaaagcacaagataggtttacagatgatcttgagaatatgtacagaacttatcctcagtacagagagatactaagaatgataatggctgctgttggtcgtggaggtgaaggtgacgttggtcaacgcattcgtgatgagatattagtaatacaggtaaaactgatggtccttggtgaatatacagttattttcgttcattgctctgctgaattgagcagttggtagtgctcatccaaaacgtagacattgtcaacaataaaatgtttggtgtgttacagagaaataccgggctgtattactaatatctcatcacgaatgcgttgaccaacgtcaccttcacctccacgaccaacagcagccattatcattcttagtatctctctgtactgaggataagttctgtacatattctcaagatcatctgtaaacctatcttgtgctttgcttatctcactgctagctccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattggcgagctcgcccgggcgggcgaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattcgggcggttaattaactaatcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgagagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacaca

SEQ ID NO: 219 - DNA, 9997 bp, Artificial sequence
  Synthetic construct, 4206
ctgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcacggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttctgcagatccagatcggatcctaaaccatgcgcgtgctgctcgtggccctggccctgctggctcttgctgccagcgccacctctcagcagatcggcacctacaccgccgagacccacccaagcctgagctggtccacctgcaagagcggcggttcctgcacgaccaacagcggcgccatcacccttgatgcgaactggcgctgggtgcacggcgtgaacaccagcaccaactgctacacgggtaacacgtggaacaccgccatctgcgacacggacgcttcctgcgcccaggactgcgcgcttgatggcgccgactactccggcacctacggcatcaccacctccggcaacagcctgcgcctgaacttcgtgaccggcagcaatgtgggcagccgcacctacctgatggccgacaacacccactaccagatcttcgacctgctgaaccaggagttcaccttcaccgtcgacgtgtcccacctgccctgcggcctgaacggcgccctctacttcgtgacgatggacgccgacggcggcgtgtccaagtacccgaacaacaaggctggcgcccagtacggtgtgggctactgcgacagccagtgcccgagggacctgaagttcatcgccggccaggccaacgtggagggctggaccccgagcagcaacaacgccaacaccggcctgggcaaccacggcgcctgctgcgccgagctggacatctgggaggccaacagcatcagcgaggccctgaccccacacccatgcgacaccccaggcctgtctgtgtgcaccaccgacgcctgcggcggcacctactccagcgaccgctacgccggcacctgcgacccagacggctgcgacttcaacccgtaccgcctgggcgtgaccgacttctacggcagcggcaagaccgtggacaccaccaagccgatcaccgtggtgacccagttcgtgaccgacgacggcaccagcaccggcaccctgagcgagatccgccgctactacgtccagaacggcgtggtgatcccgcagccgagcagcaagatcagcggcgtgtccggcaacgtgatcaacagcgacttctgcgacgccgagatcagcaccttcggcgagaccgccagcttcagcaagcacggcggcctggccaagatgggcgctggcatggaagccggcatggtgctggtgatgagcctgtgggacgactactccgtgaacatgctgtggctggacagcacctacccgaccaacgccaccgggacgccaggcgctgccaggggcagctgcccaaccacctcgggcgaccccaagaccgtcgagagccagagcggcagcagctacgtgaccttcagcgacatccgcgtgggcccgttcaactccacgttcagcggtggctctagcacgggcggctcctccaccaccaccgccagcggcaccaccaccaccaaggcctccagcacgtctactagctccacctctaccggcaccggcgttgctgcccattggggccagtgcggtggccagggctggacgggtccaacgacttgcgcctccggcaccacctgcaccgtggtcaatccgtactactcccagtgcctggacgagctgaaggccgaggccaagtgatccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtaccgtcgactctagtaacggccgccagtgtgctggaattaattcggcttgtcgaccacccaaccccatatcgacagaggatgtgaagaacaggtaaatcacgcagaagaacccatctctgatagcagctatcgattagaacaacgaatccatattgggtccgtgggaaatacttactgcacaggaagggggcgatctgacgaggccccgccaccggcctcgacccgaggccgaggccgacgaagcgccggcgagtacggcgccgcggcggcctctgcccgtgccctctgcgcgtgggagggagaggccgcggtggtgggggcgcgcgcgcgcgcgcgcgcagctggtgcggcggcgcgggggtcagccgccgagccggcggcgacggaggagcagggcggcgtggacgcgaacttccgatcggttggtcagagtgcgcgagttgggcttagccaattaggtctcaacaatctattgggccgtaaaattcatgggccctggtttgtctaggcccaatatcccgttcatttcagcccacaaatatttccccagaggattattaaggcccacacgcagcttatagcagatcaagtacgatgtttcctgatcgttggatcggaaacgtacggtcttgatcaggcatgccgacttcgtcaaagagaggcggcatgacctgacgcggagttggttccgggcaccgtctggatggtcgtaccgggaccggacacgtgtcgcgcctccaactacatggacacgtgtggtgctgccattgggccgtacgcgtggcggtgaccgcaccggatgctgcctcgcaccgccttgcccacgctttatatagagaggttttctctccattaatcgcatagcgagtcgaatcgaccgaaggggagggggagcgaagctttgcgttctctaatcgcctcgtcaaggtaactaatcaatcacctcgtcctaatcctcgaatctctcgtggtgcccgtctaatctcgcgattttgatgctcgtggtggaaagcgtaggaggatcccgtgcgagttagtctcaatctctcagggtttcgtgcgattttagggtgatccacctcttaatcgagttacggtttcgtgcgattttagggtaatcctcttaatctctcattgatttagggtttcgtgagaatcgaggtagggatctgtgttatttatatcgatctaatagatggattggttttgagattgttctgtcagatggggattgtttcgatatattaccctaatgatgtgtcagatggggattgtttcgatatattaccctaatgatgtgtcagatggggattgtttcgatatattaccctaatgatggataataagagtagttcacagttatgttttgatcctgccacatagtttgagttttgtgatcagatttagttttacttatttgtgcttagttcggatgggattgttctgatattgttccaatagatgaatagctcgttaggttaaaatctttaggttgagttaggcgacacatagtttatttcctctggatttggattggaattgtgttcttagtttttttcccctggatttggattggaattgtgtggagctgggttagagaattacatctgtatcgtgtacacctacttgaactgtagagcttgggttctaaggtcaatttaatctgtattgtatctggctctttgcctagttgaactgtagtgctgatgttgtactgtgtttttttacccgttttatttgctttactcgtgcaaatcaaatctgtcagatgctagaactaggtggctttattctgtgttcttacatagatctgttgtcctgtagttacttatgtcagttttgttattatctgaagatatttttggttgttgcttgttgatgtggtgtgagctgtgagcagcgctcttatgattaatgatgctgtccaattgtagtgtagtatgatgtgattgatatgttcatctattttgagctgacagtaccgatatcgtaggatctggtgccaacttattctccagctgcttttttttacctatgttaattccaatcctttcttgcctcttccagatccagataatggcccacgcccgcgtcctcctcctggcgctcgccgtcctggccaccgccgccgtcgccgtcgcctcctcctcctccttcgccgactccaacccgatccgcccggtgaccgaccgcgccgcctccaccgcttacgactacaagcaggtgttgcgggactcgctactattctatgaggcccagagatccggccggctcccagccgaccagaaggtcacgtggaggaaggatagcgcgctgaatgaccagggtgaccagggacaagacttgaccggcggctactttgacgctggggacttcgtcaagttcgggttccccatggcttataccgcaaccgtgctggcatggggcctcatagattttgaggccggctacagcagtgccggggccttggatgatggacggaaggctgtcaaatgggccaccgactatttcataaaggcccacacaagtcaaaatgagttctatggtcaggtcggccagggtgacgccgatcacgctttctggggaagaccagaggatatgacgatggcgcgcccggcgtacaagatagacacctcaaggcctggctctgatctggcaggcgagacagcggctgctcttgccgctgcttcaatcgtgttccggaacgtcgatggcacttactcaaataacctgttaacacacgctcgccagctattcgacttcgcgaacaactaccggggaaagtatagtgactctattactgacgcaagaaatttctacgcaagcgcagactacagagacgagttggtttgggctgctgcgtggttatacagagcgaccaacgacaacacctacctcaacactgctgagtcactgtacgatgagtttgggctacagaactggggggggggcctgaactgggatagcaaggtgtctggcgtgcaggtgttgttggccaagcttaccaataagcaggcctacaaggacacggtgcagtcttacgtcaattacctaattaataaccagcagaagactcccaagggcctcctctacatcgacatgtggggcacccttcgccacgctgccaacgccgcattcatcatgctcgaagccgccgagctgggcttgtccgcctcctcttatagacagttcgcgcaaacgcaaatcgactacgccctgggcgatggtggccgctcctttgtgtgcgggttcgggagtaatcctcctacgagaccgcaccacagatcctcgtcgtgcccgccagctcccgctacttgcgactggaatacattcaactcacctgacccaaactaccacgtcctctctggggccctagtgggcggacctgatcagaatgacaactacgtcgatgaccgttcagactatgttcacaacgaagtcgccactgattacaacgcgggtttccagtccgcgttagctgctttggtggcccttggttacagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattgggtacctctagagatgtaatggtgttaggacacgtggttagctactaatataaatgtaaggtcaaaattcgatggtttattttctattttcaattacctagcattatctcatttctaattgtgtgataacaaatgcattagaccataattctgtaaatacgtacatttaagcacacagtctatattttaaaattcttctttttgtgtggatatcccaacccaaatccacctctctcctcaatccgtgtatcttcaccgctgccaagtgccaacaacacatcgcatcgtgcaaatctttgttggtttgtgcacggtcggcgccaatggaggagacacctgtacggtgcccttggtagaacaacatccttatccctatatgtatggtgcccttcgtagaatggcaccccttatccctacaatagccatgtatgcataccaagaattaaatatactttttcttgaaccacaataatttattatagcggcacttcttgttctggttgaacacttatttggaacaataaaatcccgagttcctaaccacaggttcactttttttccttatcctcctaggaaactaaattttaaattcataaatttaattgaaatgttaatgaaaacaaaaaaattatctacaaagacgactcttagccacagccgcctcactgcaccctcaaccacatcctgcaaacagacaccctcgccacatccctccagattcttccctccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaagaagcctcagccacagccggttccgttgcggttaccgccgatcacatgcccaaggccgcgcctttccaaacgccgagggccgcccgttcccgtgcacagccacacacacacccgcccgccaacgactccccatccctatttgaacccacccgcgcactgcattgatcaccaatcgcatcgcagcagcacgagcagcacgccgtgccgctccaaccgtctcgcttccctgcttagcttcccgccgcgccatggcgaacaaacatttgtccctctccctcttcctcgtcctccttggcctgtcggccagcttggcctccgggcaagtcttcccagctggaaacgcaacggaattggagaaaagacaaaccacccctaactctgagggctggcatgacggatactactactcttggtggagcgatggtggtgcacaggccacctatacaaacctcgaaggcggcacttatgagatttcatggggtgacggtggcaaccttgtcggcggaaaggggtggaaccccggacttaacgccagggcaatccacttcgaaggggtgtaccagcccaatggcaactcatacctggccgtctacgggtggacgcgcaatccgctggttgagtactatatcgtggagaatttcggaacttatgaccctagctccggtgccacggacctcgggacagtcgagtgtgacggaagcatctacaggctgggtaaaactacccgcgttaatgctccatcgatcgacggcacgcaaacatttgatcaatactggtccgtgcggcaggataagaggacaagcggcacagttcagacgggttgccactttgatgcctgggcaagagcggggctcaatgtgaatggggaccactactatcagattgtggcgaccgagggctatttctccagtggctatgcgcgtataaccgtcgctgatgttggaagcgagaaggacgagctgtgacctaggtccccgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattg

What is claimed is:

1. A genetically engineered plant comprising:
a first isolated nucleic acid comprising a sequence of SEQ ID NO: 50 that encodes a ribonucleic acid product that inactivates or inhibits expression of at least one gene encoding a protein involved in mobilization of starch in a plant, and a second isolated nucleic acid that encodes an endo-1,4-beta-xylanase from *Thermomyces lanuginosus*, a cellobiohydrolase B and an endo-beta 1,4-endoglucanase from *Nasutitermes takasagoensis*; wherein the second isolated nucleic acid comprises a sequence of: SEQ ID NO: 86, SEQ ID NO: 87, and SEQ ID NO: 90.

2. The genetically engineered plant of claim 1 further comprising a promoter operably linked to at least one of the first isolated nucleic acid or the second isolated nucleic acid.

3. A genetic construct comprising:
a first isolated nucleic acid comprising a sequence of SEQ ID NO: 50 that encodes a ribonucleic acid product that inactivates or inhibits expression of at least one gene encoding a protein involved in mobilization of starch in a plant, and a second isolated nucleic acid that encodes an endo-1,4-beta-xylanase from *Thermomyces lanuginosus*, a cellobiohydrolase B and an endo-beta 1,4-endoglucanase from *Nasutitermes takasagoensis*; wherein the second isolated nucleic acid comprises a sequence of: SEQ ID NO: 86, SEQ ID NO: 87, and SEQ ID NO: 90.

4. The genetic construct of claim 3 further comprising a promoter operably linked to at least one of the first isolated nucleic acid or the second isolated nucleic acid.

5. A method of agricultural processing or preparing animal feed comprising pretreating a genetically engineered plant with a chemical formulation to form a mixture, wherein the genetically engineered plant comprises:
a first isolated nucleic acid comprising a sequence of SEQ ID NO: 50 that encodes a ribonucleic acid product that inactivates or inhibits expression of at least one gene encoding a protein involved in mobilization of starch in a plant, and a second isolated nucleic acid that encodes an endo-1,4-beta-xylanase from *Thermomyces lanuginosus*, a cellobiohydrolase B and an endo-beta 1,4-endoglucanase from *Nasutitermes takasagoensis*; wherein the second isolated nucleic acid comprises a sequence of: SEQ ID NO: 86, SEQ ID NO: 87, and SEQ ID NO: 90.

6. The method of claim 5, wherein the genetically engineered plant further comprises a promoter operably linked to at least the first isolated nucleic acid or the second isolated nucleic acid.

7. The method of claim 5, wherein the chemical formulation includes at least one moiety comprising an ion selected from the group consisting of: sulfite, bisulfite, sulfate, carbonate, hydroxide and oxide.

8. The method of claim 7, wherein the at least one moiety further includes a counter ion selected from the group consisting of: ammonium, sodium, magnesium and calcium.

9. The method of claim 5, wherein the chemical formulation includes a compound selected from the group consisting of: a sulfuric acid, a base, ammonium bisulfite and ammonium carbonate.

10. The method of claim 5, wherein the mixture has a liquid to solid ratio of 8 to 10.

11. The method of claim 5, wherein the pretreating includes incubating the mixture for a period from 1 hour to 16 hours.

12. The method of claim 5, wherein the pretreating includes a mixture temperature of 40° C. to 120° C.

13. The method of claim 5, wherein the pretreating includes a mixture pH ranging from 1.0 to 12.0.

14. The method of claim 13 further comprising hydrolyzing the mixture.

15. The method of claim 14, wherein the step of hydrolyzing includes incubating the mixture for a period from one hour to 144 hours.

16. The method of claim 14, wherein the step of hydrolyzing includes incubating the mixture at a temperature of 40° C. to 95° C.

17. The method of claim 16 further comprising hydrolyzing the genetically engineered plant with one or more exogenous enzymes.

18. The method of claim 17, further comprising exposing the genetically engineered plant to a fermenting organism under fermenting conditions to produce a chemical product.

19. The method of claim 17, wherein the one or more exogenous enzymes is selected from the group consisting of: a glycosidase, an endoglucanase, a cellobiohydrolase, a glycosidase, a β-xylosidase, a cellulase, a xylanase, an amylase, an invertase, a protease, a phytase, a hydrolytic enzyme, a glucanase, a hemicellulase, an esterase, a laccase, a mannanase, and a peroxidase.

20. The method of claim 5, wherein the genetically engineered plant is made using *Agrobacterium*-mediated transformation prior to the step of pretreatment.

21. The method of claim 5, wherein the genetically engineered plant is selected from the group consisting of: corn, soybean, rice, sugar cane, sugar beet, sorghum, switchgrass, miscanthus, eucalyptus, willow and poplar.

22. A method of preparing animal feed comprising at least one procedure selected from the group consisting of: drying a genetically engineered plant, pelletizing a genetically engineered plant into feed pellets, ensiling a genetically engineered plant to make silage, and combining the genetically engineered plant with distillers grains or with a source of edible fiber, wherein the genetically engineered plant comprises a first isolated nucleic acid comprising a sequence of SEQ ID NO: 50 that encodes a ribonucleic acid product that inactivates or inhibits expression of at least one gene encoding a protein involved in mobilization of starch in a plant, and a second isolated nucleic acid that encodes an endo-1,4-beta-xylanase from *Thermomyces lanuginosus*, a cellobiohydrolase B and an endo-beta 1,4-endoglucanase from *Nasutitermes takasagoensis*; wherein the second isolated nucleic acid comprises a sequence of: SEQ ID NO: 86, SEQ ID NO: 87, and SEQ ID NO: 90.

23. The method of claim 22, wherein the genetically engineered plant further comprises a promoter operably linked to at least the first isolated nucleic acid or the second isolated nucleic acid.

24. The method of claim 22, wherein the source of edible fiber is selected from the group of plants consisting of: corn, sorghum, wheat, rye, soybeans, corn grain, sorghum grain, wheat grain, rye grain, soybean meal, corn meal, corn oil, and corn germ.

25. A method of agricultural processing comprising feeding an animal with an animal feed comprising a genetically engineered plant to promote animal growth, wherein prior to the step of feeding the animal feed is prepared by at least one procedure selected from the group consisting of: drying a genetically engineered plant, pelletizing a genetically engineered plant into feed pellets, ensiling a genetically engineered plant to make silage, and combining the genetically engineered plant with distillers grains or with a source of edible fiber, and the genetically engineered plant comprises a first isolated nucleic acid comprising a sequence of SEQ ID NO: 50 that encodes a ribonucleic acid product that inactivates or inhibits expression of at least one gene encoding a protein involved in mobilization of starch in a plant, and a second isolated nucleic acid that encodes an endo-1,4-beta-xylanase from *Thermomyces lanuginosus*, a cellobiohydrolase B and an endo-beta 1,4-endoglucanase from *Nasutitermes takasagoensis*; wherein the second isolated nucleic acid comprises a sequence of: SEQ ID NO: 86, SEQ ID NO: 87, and SEQ ID NO: 90.

26. The method of claim 25, wherein the animal is selected from the group consisting of: chicken, swine, and cattle.

27. The genetically engineered plant of claim 1 comprising the nucleic acid sequence of SEQ ID NO: 139.

28. The genetic construct of claim 3 comprising the nucleic acid sequence of SEQ ID NO: 139.

29. The method of any one of claim 5, 22 or 25, wherein the genetically engineered plant comprises the isolated nucleic acid sequence of SEQ ID NO: 139.

* * * * *